US012723248B1

(12) United States Patent
Ollmann et al.

(10) Patent No.: US 12,723,248 B1
(45) Date of Patent: Sep. 1, 2026

(54) RNAi CONSTRUCTS FOR INHIBITING ASGR1 EXPRESSION AND METHODS OF USE THEREOF

(71) Applicant: AMGEN INC., Thousand Oaks, CA (US)

(72) Inventors: Michael Ollmann, San Carlos, CA (US); Yang Li, Mountain View, CA (US); Jun Zhang, Foster City, CA (US); Oliver Homann, Berkeley, CA (US); Leslie P. Miranda, Thousand Oaks, CA (US); Justin K. Murray, Moorpark, CA (US); Bin Wu, Thousand Oaks, CA (US); Oh Kyu Yoon, Pacifica, CA (US); John Gordon Allen, Newbury Park, CA (US); Chawita Netirojjanakul, Longmont, CO (US); Yuan Cheng, Newbury Park, CA (US)

(73) Assignee: AMGEN INC., Thousand Oaks, CA (US)

( * ) Notice: Subject to any disclaimer, the term of this patent is extended or adjusted under 35 U.S.C. 154(b) by 153 days.

(21) Appl. No.: 18/332,353

(22) Filed: Jun. 9, 2023

Related U.S. Application Data

(63) Continuation of application No. 17/080,771, filed on Oct. 26, 2020, now Pat. No. 11,732,266, which is a continuation of application No. 16/328,221, filed as application No. PCT/US2017/048757 on Aug. 25, 2017, now Pat. No. 10,870,856.

(60) Provisional application No. 62/380,216, filed on Aug. 26, 2016.

(51) Int. Cl.
*C12N 15/113* (2010.01)
*A61P 3/06* (2006.01)
*A61P 9/10* (2006.01)
*C07K 16/28* (2006.01)

(52) U.S. Cl.
CPC ............ *C12N 15/1138* (2013.01); *A61P 3/06* (2018.01); *A61P 9/10* (2018.01); *C07K 16/2851* (2013.01); *C07K 2317/526* (2013.01); *C12N 2310/14* (2013.01); *C12N 2310/315* (2013.01); *C12N 2310/317* (2013.01); *C12N 2310/321* (2013.01); *C12N 2310/332* (2013.01); *C12N 2310/351* (2013.01); *C12N 2310/3513* (2013.01)

(58) Field of Classification Search
None
See application file for complete search history.

(56) References Cited

U.S. PATENT DOCUMENTS

| | | | | |
|---|---|---|---|---|
| 2005/0244851 | A1* | 11/2005 | Blume | C12Q 1/6876 435/287.2 |
| 2005/0255487 | A1 | 11/2005 | Khvorova et al. | |
| 2007/0031844 | A1 | 2/2007 | Khvorova et al. | |
| 2007/0039072 | A1 | 2/2007 | Khvorova et al. | |
| 2008/0269450 | A1 | 10/2008 | Wakefield et al. | |
| 2013/0024961 | A1 | 1/2013 | Burlak | |
| 2017/0088620 | A1 | 3/2017 | Nioi et al. | |
| 2018/0305689 | A1 | 10/2018 | Sætrom et al. | |
| 2020/0283777 | A1* | 9/2020 | Li | C12N 15/1138 |

FOREIGN PATENT DOCUMENTS

| | | | |
|---|---|---|---|
| CN | 1587408 | A | 3/2005 |
| WO | 2005123128 | A2 | 12/2005 |
| WO | 2006034488 | A2 | 3/2006 |
| WO | 2012139081 | A2 | 10/2012 |
| WO | 2012177639 | A2 | 12/2012 |

OTHER PUBLICATIONS

Song et al. Biomedicine & Pharmacotherapy 180 117488, pp. 1-7 (Year: 2024).*
Fakhr et al. Cancer Gene Therapy 2016, 23, 73-82 (Year: 2016).*
Joshi et al., "siRNA: novel therapeutics from functional genomics," Biotechnology and Genetic Engineering Reviews, vol. 30(1), pp. 1-30 (2014).
Gu et al., "The asialoglycoprotein receptor suppresses the metastasis of hepatocellular carcinoma via LASS2-mediated inhibition of V-ATPase activity", Cancer Lett., vol. 379, pp. 107-116 (2016).
International Search Report and Written Opinion for PCT/US2017/048757 mailed Feb. 5, 2018.
Nioi et al., "Variant ASGR1 Associated with a Reduced Risk of Coronary Artery Disease", N. Engl. J. Med., vol. 374 (22), pp. 2131-2141 (2016).
Paris et al., "ASGR1 expressed by porcine enriched liver sinusoidal endothelial cells mediates human platelet phagocytosis in vitro", Xenotransplantation, vol. 18, pp. 245-251 (2011).
Yamamoto et al., "Serial incorporation of a monovalent GalNAc phosphoramidite unit into hepatocyte-targeting antisense oligonucleotides", Bioorg. Med. Chem., vol. 24, pp. 26-32 (2016).
Yang et al., "Antisense oligonucleotides targeted against asialoglycoprotein receptor 1 block human hepatitis B virus replication", J. Viral Hepatitis, vol. 13, pp. 158-165 (2006).
Yang et al., "Kukoamine B promotes TLR4-independent lipopolysaccharide uptake in murine hepatocytes", Oncotarget, vol. 7 (36), pp. 57498-57513 (2016).

* cited by examiner

*Primary Examiner* — Brian Whiteman
(74) *Attorney, Agent, or Firm* — Angela L. Purcell

(57) ABSTRACT

The present invention relates to RNAi constructs for reducing expression of the ASGR1 gene. Methods of using such RNAi constructs to treat or prevent cardiovascular disease, such as coronary artery disease and myocardial infarction, and to reduce serum non-HDL cholesterol levels are also described.

34 Claims, 12 Drawing Sheets

Specification includes a Sequence Listing.

1 CCCAAACGGT GCACGGAAGA GTGAGGTGAC TGGCATGTGT GGGGGCAACA CGATTCTCCT

61 CCCTGGGGAG CAGAGCAGAG GCAACCCATC CCCCACTCCC ACCCCCACAC TCCCCTAAGT

121 TCCAATCCAT TTCCACCTCT GTTTACTGTC CAAAGTCCCG GGCACTGGAG ATGCCACGTT

181 TGGCGTGCTT GGACACACAG ACACGCAGAC ACAGAGACAC CGGGGCCCAG GGCCCTCCTA

241 TGGACCCTGC CCGCTCCCCT CCCATTGTCC ACGGCTGTCC GCCCACCCCC ATTCTCCAAG

301 CTTCAGCCCC CTCCTTAGTT CGGCATCTGC ACAGCACTGA AGAACCTGGG AATCAGACCC

361 TGAGACCCTG AGCAATCCCA GGTCCAGCGC CAGCCCTATC ATGACCAAGG AGTATCAAGA

421 CCTTCAGCAT CTGGACAATG AGGAGAGTGA CCACCATCAG CTCAGAAAAG GGCCACCTCC

481 TCCCCAGCCC CTCCTGCAGC GTCTCTGCTC CGGACCTCGC CTCCTCCTGC TCTCCCTGGG

541 CCTCAGCCTC CTGCTGCTTG TGGTTGTCTG TGTGATCGGA TCCCAAAACT CCCAGCTGCA

601 GGAGGAGCTG CGGGGCCTGA GAGAGACGTT CAGCAACTTC ACAGCGAGCA CGGAGGCCCA

661 GGTCAAGGGC TTGAGCACCC AGGGAGGCAA TGTGGGAAGA AAGATGAAGT CGCTAGAGTC

721 CCAGCTGGAG AAACAGCAGA AGGACCTGAG TGAAGATCAC TCCAGCCTGC TGCTCCACGT

781 GAAGCAGTTC GTGTCTGACC TGCGGAGCCT GAGCTGTCAG ATGGCGGCGC TCCAGGGCAA

841 TGGCTCAGAA AGGACCTGCT GCCCGGTCAA CTGGGTGGAG CACGAGCGCA GCTGCTACTG

901 GTTCTCTCGC TCCGGGAAGG CCTGGGCTGA CGCCGACAAC TACTGCCGGC TGGAGGACGC

961 GCACCTGGTG GTGGTCACGT CCTGGGAGGA GCAGAAATTT GTCCAGCACC ACATAGGCCC

1021 TGTGAACACC TGGATGGGCC TCCACGACCA AAACGGGCCC TGGAAGTGGG TGGACGGGAC

1081 GGACTACGAG ACGGGCTTCA AGAACTGGAG GCCGGAGCAG CCGGACGACT GGTACGGCCA

1141 CGGGCTCGGA GGAGGCGAGG ACTGTGCCCA CTTCACCGAC GACGGCCGCT GGAACGACGA

1201 CGTCTGCCAG AGGCCCTACC GCTGGGTCTG CGAGACAGAG CTGGACAAGG CCAGCCAGGA

1261 GCCACCTCTC CTTTAATTTA TTTCTTCAAT GCCTCGACCT GCCGCAGGGG TCCGGGATTG

1321 GGAATCCGCC CATCTGGGGG CCTCTTCTGC TTTCTCGGGA ATTTTCATCT AGGATTTTAA

1381 GGGAAGGGGA AGGATAGGGT GATGTTCCGA AGGTGAGGAG CTTGAAACCC GTGGCGCTTT

1441 CTGCAGTTTG CAGGTTATCA TTGTGAACTT TTTTTTTTTA AGAGTAAAAA GAAATATACC

1501 TAAAAAAAAA AAAAAAAAA (SEQ ID NO: 1)

FIG. 1A

1 CCCAAACGGT GCACGGAAGA GTGAGGTGAC TGGCATGTGT GGGGGCAACA CGATTCTCCT

61 CCCTGGGGAG CAGAGCAGAG GCAACCCATC CCCCACTCCC ACCCCCACAC TCCCCTAAGT

121 TCCAATCCAT TTCCACCTCT GTTTACTGTC CAAAGTCCCG GGCACTGGAG ATGCCACGTT

181 TGGCGTGCTT GGACACACAG ACACGCAGAC ACAGAGACAC CGGGGCCCAG GGCCCTCCTA

241 TGGACCCTGC CCGCTCCCCT CCCATTGTCC ACGGCTGTCC GCCCACCCCC ATTCTCCAAG

301 CTTCAGCCCC CTCCTTAGTT CGGCATCTGC ACAGCACTGA AGAACCTGGG AATCAGACCC

361 TGAGACCCTG AGCAATCCCA GGTCCAGCGC CAGCCCTATC ATGACCAAGG AGTATCAAGA

421 CCTTCAGCAT CTGGACAATG AGGAGAGTGA CCACCATCAG CTCAGAAAAG ACTCCCAGCT

481 GCAGGAGGAG CTGCGGGGCC TGAGAGAGAC GTTCAGCAAC TTCACAGCGA GCACGGAGGC

541 CCAGGTCAAG GGCTTGAGCA CCCAGGGAGG CAATGTGGGA AGAAAGATGA AGTCGCTAGA

601 GTCCCAGCTG GAGAAACAGC AGAAGGACCT GAGTGAAGAT CACTCCAGCC TGCTGCTCCA

661 CGTGAAGCAG TTCGTGTCTG ACCTGCGGAG CCTGAGCTGT CAGATGGCGG CGCTCCAGGG

721 CAATGGCTCA GAAAGGACCT GCTGCCCGGT CAACTGGGTG GAGCACGAGC GCAGCTGCTA

781 CTGGTTCTCT CGCTCCGGGA AGGCCTGGGC TGACGCCGAC AACTACTGCC GGCTGGAGGA

841 CGCGCACCTG GTGGTGGTCA CGTCCTGGGA GGAGCAGAAA TTTGTCCAGC ACCACATAGG

901 CCCTGTGAAC ACCTGGATGG GCCTCCACGA CCAAAACGGG CCCTGGAAGT GGGTGGACGG

961 GACGGACTAC GAGACGGGCT TCAAGAACTG GAGGCCGGAG CAGCCGGACG ACTGGTACGG

1021 CCACGGGCTC GGAGGAGGCG AGGACTGTGC CCACTTCACC GACGACGGCC GCTGGAACGA

1081 CGACGTCTGC CAGAGGCCCT ACCGCTGGGT CTGCGAGACA GAGCTGGACA AGGCCAGCCA

1141 GGAGCCACCT CTCCTTTAAT TTATTTCTTC AATGCCTCGA CCTGCCGCAG GGGTCCGGGA

1201 TTGGGAATCC GCCCATCTGG GGGCCTCTTC TGCTTTCTCG GGAATTTTCA TCTAGGATTT

1261 TAAGGGAAGG GGAAGGATAG GGTGATGTTC CGAAGGTGAG GAGCTTGAAA CCCGTGGCGC

1321 TTTCTGCAGT TTGCAGGTTA TCATTGTGAA CTTTTTTTTT TTAAGAGTAA AAAGAAATAT

1381 ACCTAAAAAA AAAAAAAAAA AA (SEQ ID NO: 2)

FIG. 1B

1 CACATGGGCC CTGGATGGAC CCTGTCCCCT CCCCTCCCAT TGCCCAGGGC TCTTCACCTG

61 GTTCTTCAGG CTTCAGCCCC CTCCTTAGCC TGGGCTCTTC GTGGTGCTGA GGGACCTTCA

121 GTCCGGATCC AGTGCCATCA TGACAAAGGA TTATCAAGAT TTCCAGCACC TGGACAATGA

181 TAATGACCAT CATCAACTCC GGAGAGGGCC GCCTCCCACT CCACGGCTCT TGCAGCGACT

241 CTGCTCTGGA TCCCGCCTCC TCCTGCTCTC CTCGAGCCTC AGCATTCTGT TGCTGGTGGT

301 TGTCTGTGTG ATCACATCCC AAAATTCCCA ACTCCGGGAA GATCTGCTGG CTCTAAGGCA

361 GAATTTCAGC AACCTCACTG TGAGCACTGA GGACCAGGTC AAGGCCCTGA GCACCCAGGG

421 AAGTAGTGTG GGAAGAAAGA TGAAGTTAGT GGAGTCGAAG CTGGAAAAAC AGCAGAAGGA

481 TCTGACTGAA GATCACTCCA GTTTGCTACT GCACGTGAAG CAGTTAGTGT CTGACGTGCG

541 AAGCTTGAGC TGCCAGATGG CTGCATTTCG GGGCAATGGC TCTGAAAGGA CCTGCTGCCC

601 CATCAACTGG GTGGAGTATG AAGGCAGCTG CTACTGGTTC TCCAGCTCTG TGAGGCCTTG

661 GACTGAAGCT GACAAGTACT GCCAGCTGGA AAATGCCCAT CTGGTGGTGG TGACCTCCAG

721 GGATGAGCAG AACTTCCTCC AGCGCCACAT GGGCCCCTTA AACACTTGGA TTGGCCTAAC

781 TGACCAGAAC GGGCCCTGGA AATGGGTGGA TGGAACAGAC TACGAGACAG GCTTCCAGAA

841 TTGGAGACCA GAGCAGCCAG ATAACTGGTA CGGACATGGG CTTGGAGGAG GCGAGGACTG

901 TGCCCACTTC ACGACGGATG GCCGCTGGAA TGACGACGTC TGCAGGAGGC CCTACCGCTG

961 GGTCTGTGAG ACAAAGTTGG ATAAGGCTAA TTAGGAACCT TCCTTCCCCT CATTTATATC

1021 CTTAATTCCT TGAGCTGCTG AGGTTTAGAA CTGGTAGAGC CTACCTAAGG GTCTCCCCAT

1081 CTCCAGGAAC TCTCATGTAG GATTTTTAAA GGACCGGTAA AGAATGGTGT TTGAGAAATG

1141 GTGTATGATG CCTGGTGGTG GTAGGGGTGC GTATTGAAAC CCAGCGCGCA GTTCTCTTCT

1201 GTCAGCTTGT TTTTTTTAGA GTAAAAGGAA GAGAAATAAA AGTTC (SEQ ID NO: 3011)

FIG. 2

1 CTGTCCACCT GGTTCTTCAG GCTTCAGCCC CCTCCTTAGC CTGGGCTCTT CGTGGTGCTG

61 AGGGACCTTC AGTCCTGCCC CAGTGCTATC ATGACAAAGG ATTATCAAGA TTTCCAGCAC

121 TTGGACAATG AGAACGACCA CCATCAACTC CAGAGAGGGC CACCTCCCGC TCCAAGGCTC

181 TTGCAGCGAC TCTGCTCTGG ATTCCGTCTC TTCCTGCTTT CCCTGGGCCT CAGCATCCTG

241 CTGCTGGTGG TTGTCTGTGT GATCACATCC CAAAATTCCC AACTCCGGGA AGATCTGCGG

301 GTTCTAAGGC AGAATTTCAG CAACTTTACC GTGAGCACTG AGGACCAGGT CAAGGCCCTG

361 ACCACCCAGG GAGAGAGAGT GGGAAGAAAG ATGAAGTTAG TCGAGTCACA GCTGGAAAAA

421 CATCAGGAGG ATCTGAGGGA AGACCACTCT AGATTGCTAC TGCATGTAAA GCAGTTAGTG

481 TCTGACGTGC GAAGCTTGAG CTGCCAGATG GCCGCACTTC GGGGCAATGG CTCTGAAAGG

541 ATCTGCTGCC CCATCAACTG GGTGGAGTAT GAAGGCAGCT GCTACTGGTT CTCCAGCTCT

601 GTGAAGCCTT GGACGGAAGC TGACAAGTAC TGCCAGCTGG AGAACGCCCA CCTGGTGGTG

661 GTGACTTCCT GGGAGGAGCA GAGATTCGTC CAGCAACACA TGGGCCCCTT AAATACTTGG

721 ATTGGCCTAA CTGACCAGAA CGGACCCTGG AAATGGGTGG ATGGGACAGA CTATGAGACA

781 GGCTTCAAGA ACTGGAGACC AGGGCAGCCA GATGACTGGT ACGGACATGG GCTTGGAGGG

841 GGTGAAGACT GTGCCCACTT CACCACCGAT GGCCACTGGA ATGATGACGT CTGCAGGAGG

901 CCCTACCGCT GGGTCTGTGA GACAGAGTTG GGCAAGGCCA ATTAGGAGCC TCCATTCCCC

961 TGATTTATTT CCTGAGTGCC TTGAGCTGTG AGGCTTAGAG TTGGGAGGTC CTACTCAAGG

1021 GTCTCCCCAT CTTTGGGAAC TTTCATCTAG GATTTTAAGG GGCTGGTAAA GAATGGTGTT

1081 TGAGGAATGT GGTATGATGC CTGGTGGTGG TGGTGGTGGT GGTTATTGGA ACCCATGACA

1141 CTTTGTGCAG TGTGCAGCTT ACTACTGCCA ACTTGTTTTT GAGAGTAAAA GAAGGAAGAT

1201 AAAC (SEQ ID NO: 3012)

FIG. 3

1 TTACTGTCCA AAGTCCCGGG CACTGGAGAT GCCACGTTTG GCGTGCTTGG ACACACAGAC

61 ACGCAGACAC AGAGACACCG GGGCCCAGGG CCCTCCTATG GACCCTGCCC GCTCCCACTC

121 CATCGTCCAC GGCTGTCCAC CCACCCCCAT TCTCCAAGCT TCAGCCCCCC TCCTTAGTCC

181 GGCATCTGCA CAGCACTGAA GAACCTGGGA GTCAGACCCT GAGACCCCGA GCAACTCTAG

241 TCCTCGTGAG CCCCCACCTC AGCCCCAGCC TCAGCCTTGA CTCAGTCCCA GCTCCAGCAC

301 CAGCCCTATC ATGACCAAGG AGTATCAGGA CCTGCAGCAT CTGGACAATG AGGAGAGTGA

361 CCACCATCAG CTCGGAAAAG GGCCACCTCC TCCGCAGTCC CTCCTGCGGC GTCTCTGCTC

421 CGGCCCTCGC CTCCTCCTGC TCTCCCTGGG CCTCAGCCTC CTGCTGCTGG TGGTTGTCTG

481 TGTGATCGGA TCCCAAAACG CCCAGCTGCA GCGGGAGCTG CGGGGCCTGA GAGAGACGCT

541 CAGCAACTTC ACAGCGAGCA CCGAGGCCCA GGTCAAGGGC TTGAGCACCC AGGGAGGCAA

601 TGTGGGAAGA AAGATGAAGT CGCTGGAGTC CCAGCTGGAG AAACAGCAGA AGGACTTGAG

661 TGAAGATCAC TCCAGCCTGC TGCTCCACGT GAAGCAGTTC GTGTCTGACC TGCGGAGCCT

721 GAGCTGTCAG ATGGCGGCGC TCCAGGGCAA TGGCTCGGAA AGGGCCTGCT GCCCAGTCAA

781 CTGGGTGGAG CACGAGCGCA GCTGCTACTG GTTCTCTCGC TCCGGGAAGG CCTGGGCCGA

841 CGCCGACAAC TACTGCCGGC TGGAGGACGC GCACCTGGTG GTGGTCACGT CCTGGGAGGA

901 GCAGAAATTT GTCCAGCACC ACATAGGTCC TGTGAACACC TGGATGGGCC TCCACGACCA

961 AAACGGGCCC TGGAAGTGGG TGGACGGGAC GGACTACGAG ACGGGCTTCA AGAACTGGAG

1021 ACCGGAGCAG CCGGACGACT GGTACGGCCA CGGGCTCGGG GGAGGGGAGG ACTGTGCCCA

1081 CTTCACCGAC GACGGCCGCT GGAACGACGA CGTCTGCCAG AGGCCCTACC GCTGGGTCTG

1141 CGAGACAGAG CTGGACAAGG CCAGTCAGGA GCCACCTCTC CTTTAATTTA TTTCTTCAGT

1201 GCCTCGACCT GCCGCAGGGG TCCGGGGTTG GGAATCCGCC CGTCTGGGGG CCTCTTCTGC

1261 TTTCTCGGGG ATTTTCATGT AGGATTTTAA GGGAAGGGGA AGGATAGGAT GATGTTGGGA

1321 AGGTGGGGGA CTTGAAACCC GTGGCGCTTT CTGTAGTTTG CACGTTATCA TTGTCAACTT

1381 TTTTTTTTTT TTAGAGTAAA AAGAAATATA CCTAAAC (SEQ ID NO: 3013)

FIG. 4

Modification of siRNA with linker and chemoselective functional group

Uncapping and conjugation of cysteine-engineered mAb to siRNA

RNAi CONSTRUCTS FOR INHIBITING ASGR1 EXPRESSION AND METHODS OF USE THEREOF

CROSS-REFERENCE TO RELATED APPLICATIONS

This application is a continuation of U.S. application Ser. No. 17/080,771, filed Oct. 26, 2020, which is a continuation of U.S. application Ser. No. 16/328,221, now U.S. Pat. No. 10,870,856, filed Feb. 25, 2019, which is the national stage entry of PCT Application No. PCT/US2017/048757, filed Aug. 25, 2017, which claims the benefit of U.S. Provisional Application No. 62/380,216, filed Aug. 26, 2016, all of which are hereby incorporated by reference in their entireties.

DESCRIPTION OF THE TEXT FILE SUBMITTED ELECTRONICALLY

The present application contains a Sequence Listing, which has been submitted electronically in XML format and is hereby incorporated by reference in its entirety. The computer readable format copy of the Sequence Listing, which was created on May 9, 2025, is named A-2094-US04-CNT_Seqlisting and is 22,108,709 bytes in size.

FIELD OF THE INVENTION

The present invention relates to compositions and methods for modulating liver expression of asialoglycoprotein receptor 1 (ASGR1). In particular, the present invention relates to nucleic acid-based therapeutics for reducing ASGR1 expression via RNA interference and methods of using such nucleic acid-based therapeutics to treat or prevent cardiovascular disease.

BACKGROUND OF THE INVENTION

Despite the many advancements and new therapeutics that have emerged over the last several years, cardiovascular disease remains the leading cause of death worldwide. One out of every three adults in America has some form of cardiovascular disease, including coronary artery disease, myocardial infarction, angina, heart failure, and stroke (Heart disease and stroke statistics—2016 update: a report from the American Heart Association. *Circulation*, Vol. 133: e38-e360, 2016). In 2013, over 17.3 million people globally and 1.4 million people in the United States died from some form of cardiovascular disease, accounting for 31% of all global deaths and 54% of all deaths in the U.S. that year (Heart disease and stroke statistics—2016 update). Cardiovascular disease currently claims more lives each year than the next two leading causes of death, cancer and chronic lower respiratory disease, combined (Heart disease and stroke statistics—2016 update). Thus, there remains a need for additional therapeutic agents for the treatment of cardiovascular disease.

The asialoglycoprotein receptor is a calcium-dependent receptor expressed on the surface of hepatocytes that contributes to the removal and degradation of desialylated glycoproteins from the serum by binding to ligands with terminal galactose and N-acetylgalactosamine residues (Weigel, Bioessays, Vol. 16:519-524, 1994; Stockert, Physiol. Rev., Vol. 75:591-609, 1995). The hetero-oligomeric asialoglycoprotein receptor is comprised of two different proteins, a 48 kDa asialoglycoprotein receptor 1 (ASGR1) major subunit and a 40 kDa asialoglycoprotein receptor 2 (ASGR2) minor subunit (see, e.g., Stockert, 1995). The asialogylcoprotein receptor has been implicated in the clearance of low density lipoproteins and chylomicron remnants, suggesting a role for the receptor in lipoprotein metabolism (Windler et al., Biochem J., Vol. 276 (Pt 1): 79-87, 1991; Ishibashi et al., J Biol Chem., Vol. 271:22422-22427, 1996). Recently, human carriers of loss of function variant alleles of the ASGR1 subunit of the asialoglycoprotein receptor were reported to have lower serum levels of non-high-density lipoprotein (HDL) cholesterol and a lower risk of coronary artery disease and myocardial infarction as compared to non-carriers (Nioi et al., New England Journal of Medicine, Vol. 374 (22): 2131-2141, 2016). Accordingly, therapeutics targeting ASGR1 function represent a novel approach to reducing non-HDL cholesterol levels and treating cardiovascular disease, particularly coronary artery disease.

SUMMARY OF THE INVENTION

The present invention is based, in part, on the design and generation of RNAi constructs that target the ASGR1 gene and reduce expression of ASGR1 in liver cells. The sequence-specific inhibition of ASGR1 expression is useful for treating or preventing conditions associated with ASGR1 expression, such as cardiovascular disease. Accordingly, in one embodiment, the present invention provides an RNAi construct comprising a sense strand and an antisense strand, wherein the antisense strand comprises a region having a sequence that is complementary to an ASGR1 mRNA sequence. In certain embodiments, the antisense strand comprises a region having at least 15 contiguous nucleotides from an antisense sequence listed in Table 1, Table 6, or Table 8.

In some embodiments, the sense strand of the RNAi constructs described herein comprises a sequence that is sufficiently complementary to the sequence of the antisense strand to form a duplex region of about 15 to about 30 base pairs in length. In these and other embodiments, the sense and antisense strands each are about 15 to about 30 nucleotides in length. In some embodiments, the RNAi constructs comprise at least one blunt end. In other embodiments, the RNAi constructs comprise at least one nucleotide overhang. Such nucleotide overhangs may comprise 1 to 6 unpaired nucleotides and can be located at the 3' end of the sense strand, the 3' end of the antisense strand, or the 3' end of both the sense and antisense strand. In certain embodiments, the RNAi constructs comprise an overhang of two unpaired nucleotides at the 3' end of the sense strand and the 3' end of the antisense strand. In other embodiments, the RNAi constructs comprise an overhang of two unpaired nucleotides at the 3' end of the antisense strand and a blunt end of the 3' end of the sense strand/5' end of the antisense strand.

The RNAi constructs of the invention may comprise one or more modified nucleotides, including nucleotides having modifications to the ribose ring, nucleobase, or phosphodiester backbone. In some embodiments, the RNAi constructs comprise one or more 2'-modified nucleotides. Such 2'-modified nucleotides can include 2'-fluoro modified nucleotides, 2'-O-methyl modified nucleotides, 2'-O-methoxyethyl modified nucleotides, 2'-O-allyl modified nucleotides, bicyclic nucleic acids (BNA), or combinations thereof. In one particular embodiment, the RNAi constructs comprise one or more 2'-fluoro modified nucleotides, 2'-O-methyl modified nucleotides, or combinations thereof. In some embodiments, all of the nucleotides in the sense and antisense strand of the RNAi construct are modified nucleotides.

In some embodiments, the RNAi constructs comprise at least one backbone modification, such as a modified internucleotide or internucleoside linkage. In certain embodiments, the RNAi constructs described herein comprise at least one phosphorothioate internucleotide linkage. In particular embodiments, the phosphorothioate internucleotide linkages may be positioned at the 3' or 5' ends of the sense and/or antisense strands.

In some embodiments, the antisense strand and/or the sense strand of the RNAi constructs of the invention may comprise or consist of a sequence from the antisense and sense sequences listed in Tables 1, 6, or 8. In certain embodiments, the RNAi construct may be any one of the duplex compounds listed in any one of Tables 1 to 10. In one embodiment, the RNAi construct is D-1098, D-1176, D-1200, D-1206, D-1235, D-1246, D-1373, D-1389, D-1813, D-1815, D-1983, D-2000, D-2045, D-2142, D-2143, D-1438, D-1494, D-2357, D-2359, D-2361, D-2365, D-2461, D-3036, D-3037, D-3051, D-3053, D-3057, D-3779, D-3780, D-3782, D-3788, D-3791, D-3795, D-3799, or D-3800. In another embodiment, the RNAi construct is D-1200, D-1206, D-1235, D-1815, D-2143, D-2359, D-2361, D-2365, D-2142, D-1176, D-3779, D-3782, D-3788, D-3799, or D-3800. In another embodiment, the RNAi construct is D-2359. In another embodiment, the RNAi construct is D-1815. In yet another embodiment, the RNAi construct is D-1235. In still another embodiment, the RNAi construct is D-2143. In another embodiment, the RNAi construct is D-2361. In some embodiments, the RNAi construct is D-3782. In other embodiments, the RNAi construct is D-3799.

The RNAi constructs may further comprise a ligand to facilitate delivery or uptake of the RNAi constructs to specific tissues or cells, such as liver cells. In certain embodiments, the ligand targets delivery of the RNAi constructs to hepatocytes. In these and other embodiments, the ligand may comprise galactose, galactosamine, or N-acetyl-galactosamine (GalNAc). In certain embodiments, the ligand comprises a multivalent galactose or multivalent GalNAc moiety, such as a trivalent or tetravalent galactose or GalNAc moiety. The ligand may be covalently attached to the 5' or 3' end of the sense strand of the RNAi construct, optionally through a linker. In some embodiments, the RNAi constructs comprise a ligand and linker having a structure according to any of Formulas I to XXIX described herein. In certain embodiments, the RNAi constructs comprise a ligand and linker having a structure according to Formula VII, Formula VIII, Formula XVI, Formula XXVI, or Formula XXIX. In one embodiment, the RNAi constructs comprise a ligand and linker having a structure according to Formula XVI, wherein n=1 and k=3.

In certain embodiments, the ligand may comprise an antibody or antigen-binding fragment thereof that specifically binds to ASGR1. The 5' or 3' end of the sense strand of the RNAi construct may be covalently linked to the antibody or antigen-binding fragment through the side chain of an amino acid residue in the light chain or heavy chain of the antibody or antigen-binding fragment. In some embodiments, the sense strand of the RNAi construct is covalently attached, optionally through a linker, to the side chain of a cysteine residue present in the heavy chain or light chain of the antibody or antigen-binding fragment thereof. In one embodiment, the anti-ASGR1 antibody-RNA molecule conjugate comprises at least one copy of the interfering RNA molecule (e.g. siRNA or shRNA). In another embodiment, the anti-ASGR1 antibody-RNA molecule conjugate comprises two copies of the interfering RNA molecule (e.g. siRNA or shRNA).

The present invention also provides pharmaceutical compositions comprising any of the RNAi constructs described herein and a pharmaceutically acceptable carrier, excipient, or diluent. Such pharmaceutical compositions are particularly useful for reducing expression of ASGR1 in the cells (e.g. liver cells) of a patient in need thereof. Patients who may be administered a pharmaceutical composition of the invention can include patients with a history of myocardial infarction, patients diagnosed with or at risk for coronary artery disease or other form of cardiovascular disease, and patients with elevated levels of non-HDL cholesterol. Accordingly, the present invention includes methods of treating or preventing cardiovascular disease in a patient in need thereof by administering an RNAi construct or pharmaceutical composition described herein. In certain embodiments, the present invention provides methods for reducing non-HDL cholesterol in a patient in need thereof by administering an RNAi construct or pharmaceutical composition described herein.

The use of ASGR1-targeting RNAi constructs in any of the methods described herein or for preparation of medicaments for administration according to the methods described herein is specifically contemplated. For instance, the present invention includes an ASGR1-targeting RNAi construct for use in a method for treating or preventing cardiovascular disease, including coronary artery disease or myocardial infarction, in a patient in need thereof. The present invention also includes an ASGR1-targeting RNAi construct for use in a method for reducing non-HDL cholesterol in a patient in need thereof. In some embodiments, the present invention provides an ASGR1-targeting RNAi construct for use in a method for reducing the risk of myocardial infarction in a patient in need thereof.

The present invention also encompasses the use of an ASGR1-targeting RNAi construct in the preparation of a medicament for treating or preventing cardiovascular disease, including coronary artery disease or myocardial infarction, in a patient in need thereof. In certain embodiments, the present invention provides the use of an ASGR1-targeting RNAi construct in the preparation of a medicament for reducing non-HDL cholesterol in a patient in need thereof. In certain other embodiments, the present invention provides the use of an ASGR1-targeting RNAi construct in the preparation of a medicament for reducing the risk of myocardial infarction in a patient in need thereof.

BRIEF DESCRIPTION OF THE DRAWINGS

FIG. 1A shows the nucleotide sequence of transcript variant 1 of human ASGR1 (NCBI Reference Sequence No. NM_001671.4; SEQ ID NO: 1). The transcript sequence is depicted as the complementary DNA (cDNA) sequence with thymine bases replacing uracil bases.

FIG. 1B shows the nucleotide sequence of transcript variant 2 of human ASGR1 (NCBI Reference Sequence No. NM_001197216.2; SEQ ID NO: 2). The transcript sequence is depicted as the cDNA sequence with thymine bases replacing uracil bases.

FIG. 2 shows the nucleotide sequence of transcript variant 1 of mouse Asgr1 (NCBI Reference Sequence No. NM_009714.2; SEQ ID NO: 3011). The transcript sequence is depicted as the complementary DNA (cDNA) sequence with thymine bases replacing uracil bases.

FIG. 3 shows the nucleotide sequence of a transcript of rat Asgr1 (SEQ ID NO: 3012). The transcript sequence is depicted as the complementary DNA (cDNA) sequence with thymine bases replacing uracil bases.

FIG. 4 shows the nucleotide sequence of a transcript of macaque (*Macaca fascicularis*) ASGR1 (NCBI Reference Sequence No. XM_005582698.1; SEQ ID NO: 3013). The transcript sequence is depicted as the complementary DNA (cDNA) sequence with thymine bases replacing uracil bases.

DETAILED DESCRIPTION

Figure 5:
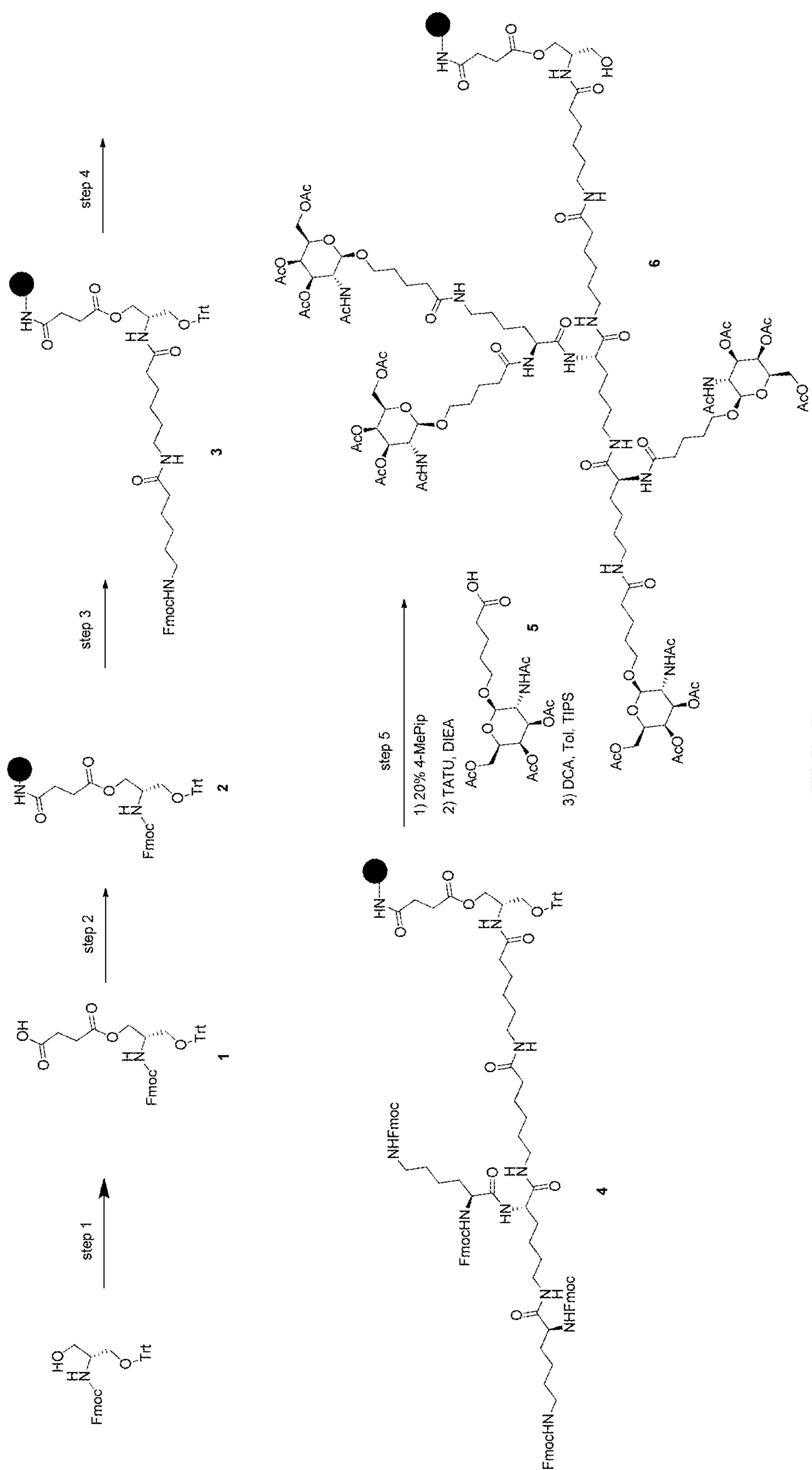
FIG. 5 depicts the synthetic scheme for a tetravalent GalNAc moiety that can be incorporated into any of the RNAi constructs of the invention.

The present invention is directed to compositions and methods for regulating the expression of the asialoglycoprotein receptor in a cell or mammal. In some embodiments, compositions of the invention comprise RNAi constructs that target an ASGR1 mRNA and reduce ASGR1 expression in a cell or mammal. Such RNAi constructs are useful for treating or preventing various forms of cardiovascular disease, such as, for example, by reducing non-HDL cholesterol serum levels and reducing the risk of developing coronary artery disease or myocardial infarction.

As used herein, the term "RNAi construct" refers to an agent comprising a RNA molecule that is capable of downregulating expression of a target gene (e.g. ASGR1) via a RNA interference mechanism when introduced into a cell. RNA interference is the process by which a nucleic acid molecule induces the cleavage and degradation of a target RNA molecule (e.g. messenger RNA or mRNA molecule) in a sequence-specific manner, e.g. through a RNA-induced silencing complex (RISC) pathway. In some embodiments, the RNAi construct comprises a double-stranded RNA molecule comprising two antiparallel strands of contiguous nucleotides that are sufficiently complementary to each other to hybridize to form a duplex region. "Hybridize" or "hybridization" refers to the pairing of complementary polynucleotides, typically via hydrogen bonding (e.g. Watson-Crick, Hoogsteen or reversed Hoogsteen hydrogen bonding) between complementary bases in the two polynucleotides. The strand comprising a region having a sequence that is substantially complementary to a target sequence (e.g. target mRNA) is referred to as the "antisense strand." The "sense strand" refers to the strand that includes a region that is substantially complementary to a region of the antisense strand. In some embodiments, the sense strand may comprise a region that has a sequence that is substantially identical to the target sequence.

A double-stranded RNA molecule may include chemical modifications to ribonucleotides, including modifications to the ribose sugar, base, or backbone components of the ribonucleotides, such as those described herein or known in the art. Any such modifications, as used in a double-stranded RNA molecule (e.g. siRNA, shRNA, or the like), are encompassed by the term "double-stranded RNA" for the purposes of this disclosure.

As used herein, a first sequence is "complementary" to a second sequence if a polynucleotide comprising the first sequence can hybridize to a polynucleotide comprising the second sequence to form a duplex region under certain conditions, such as physiological conditions. Other such conditions can include moderate or stringent hybridization conditions, which are known to those of skill in the art. A first sequence is considered to be fully complementary (100% complementary) to a second sequence if a polynucleotide comprising the first sequence base pairs with a polynucleotide comprising the second sequence over the entire length of one or both nucleotide sequences without any mismatches. A sequence is "substantially complementary" to a target sequence if the sequence is at least about 80%, 85%, 90%, 95%, 96%, 97%, 98%, or 99% complementary to a target sequence. Percent complementarity can be calculated by dividing the number of bases in a first sequence that are complementary to bases at corresponding positions in a second or target sequence by the total length of the first sequence. A sequence may also be said to be substantially complementary to another sequence if there are no more than 5, 4, 3, or 2 mismatches over a 30 base pair duplex region when the two sequences are hybridized. Generally, if any nucleotide overhangs, as defined herein, are present, the sequence of such overhangs is not considered in determining the degree of complementarity between two sequences. By way of example, a sense strand of 21 nucleotides in length and an antisense strand of 21 nucleotides in length that hybridize to form a 19 base pair duplex region with a 2 nucleotide overhang at the 3' end of each strand would be considered to be fully complementary as the term is used herein.

In some embodiments, a region of the antisense strand comprises a sequence that is fully complementary to a region of the target RNA sequence (e.g. ASGR1 mRNA). In such embodiments, the sense strand may comprise a sequence that is fully complementary to the sequence of the antisense strand. In other such embodiments, the sense strand may comprise a sequence that is substantially complementary to the sequence of the antisense strand, e.g. having 1, 2, 3, 4, or 5 mismatches in the duplex region formed by the sense and antisense strands. In certain embodiments, it is preferred that any mismatches occur within the terminal regions (e.g. within 6, 5, 4, 3, or 2 nucleotides of the 5' and/or 3' ends of the strands). In one embodiment, any mismatches in the duplex region formed from the sense and antisense strands occur within 6, 5, 4, 3, or 2 nucleotides of the 5' end of the antisense strand.

In certain embodiments, the sense strand and antisense strand of the double-stranded RNA may be two separate molecules that hybridize to form a duplex region, but are otherwise unconnected. Such double-stranded RNA molecules formed from two separate strands are referred to as "small interfering RNAs" or "short interfering RNAs" (siRNAs). Thus, in some embodiments, the RNAi constructs of the invention comprise a siRNA.

In other embodiments, the sense strand and the antisense strand that hybridize to form a duplex region may be part of a single RNA molecule, i.e. the sense and antisense strands are part of a self-complementary region of a single RNA molecule. In such cases, a single RNA molecule comprises a duplex region (also referred to as a stem region) and a loop region. The 3' end of the sense strand is connected to the 5' end of the antisense strand by a contiguous sequence of unpaired nucleotides, which will form the loop region. The loop region is typically of a sufficient length to allow the RNA molecule to fold back on itself such that the antisense strand can base pair with the sense strand to form the duplex or stem region. The loop region can comprise from about 3 to about 25, from about 5 to about 15, or from about 8 to about 12 unpaired nucleotides. Such RNA molecules with at least partially self-complementary regions are referred to as "short hairpin RNAs" (shRNAs). In certain embodiments, the RNAi constructs of the invention comprise a shRNA. The length of a single, at least partially self-complementary RNA molecule can be from about 35 nucleotides to about 100 nucleotides, from about 45 nucleotides to about 85 nucleotides, or from about 50 to about 60 nucleotides and comprise a duplex region and loop region each having the lengths recited herein.

In some embodiments, the RNAi constructs of the invention comprise a sense strand and an antisense strand, wherein the antisense strand comprises a region having a sequence that is substantially or fully complementary to an ASGR1 messenger RNA (mRNA) sequence. As used herein, an "ASGR1 mRNA sequence" refers to any messenger RNA sequence, including splice variants, encoding an ASGR1 protein, including ASGR1 protein variants or isoforms from any species (e.g. mouse, rat, non-human primate, human). ASGR1 protein (also known as HL-1, ASGPR H1, ASGPR1, and CLEC4H1), as used herein, refers to the major subunit of the asialoglycoprotein receptor. In humans, ASGR1 is found on chromosome 17p13.2 and is expressed as two different isoforms, a long isoform (Hla or isoform A) of about 291 amino acids and a short soluble isoform (H1b or isoform B) of about 252 amino acids.

An ASGR1 mRNA sequence also includes the transcript sequence expressed as its complementary DNA (cDNA) sequence. A cDNA sequence refers to the sequence of an mRNA transcript expressed as DNA bases (e.g. guanine, adenine, thymine, and cytosine) rather than RNA bases (e.g. guanine, adenine, uracil, and cytosine). Thus, the antisense strand of the RNAi constructs of the invention may comprise a region having a sequence that is substantially or fully complementary to a target ASGR1 mRNA sequence or ASGR1 cDNA sequence. An ASGR1 mRNA or cDNA sequence can include, but is not limited to, any ASGR1 mRNA or cDNA sequence selected from the NCBI Reference sequences NM_001671.4 (human; FIG. 1A, SEQ ID NO: 1), NM_001197216.2 (human; FIG. 1B, SEQ ID NO: 2), NM_009714.2 (mouse; FIG. 2, SEQ ID NO: 3011), and XM_005582698.1 (cynomolgus monkey; FIG. 4, SEQ ID NO: 3013) or the rat sequence in FIG. 3 (SEQ ID NO: 3012). In one embodiment, the ASGR1 mRNA sequence is human transcript variant 1 listed in the NCBI database as Reference Sequence NM_001671.4 (see FIG. 1A; SEQ ID NO: 1). In another embodiment, the ASGR1 mRNA sequence is human transcript variant 2 listed in the NCBI database as Reference Sequence NM_001197216.2 (see FIG. 1B; SEQ ID NO: 2).

A region of the antisense strand can be substantially complementary or fully complementary to at least 15 consecutive nucleotides of the ASGR1 mRNA sequence. In some embodiments, the target region of the ASGR1 mRNA sequence to which the antisense strand comprises a region of complementarity can range from about 15 to about 30 consecutive nucleotides, from about 16 to about 28 consecutive nucleotides, from about 18 to about 26 consecutive nucleotides, from about 17 to about 24 consecutive nucleotides, from about 19 to about 25 consecutive nucleotides, from about 19 to about 23 consecutive nucleotides, or from about 19 to about 21 consecutive nucleotides. In certain embodiments, the region of the antisense strand comprising a sequence that is substantially or fully complementary to an ASGR1 mRNA sequence may, in some embodiments, comprise at least 15 contiguous nucleotides from an antisense sequence listed in Table 1, Table 6, or Table 8. In other embodiments, the antisense sequence comprises at least 16, at least 17, at least 18, or at least 19 contiguous nucleotides from an antisense sequence listed in Table 1, Table 6, or Table 8. For instance, in some embodiments, the region of the antisense strand comprising a sequence that is substantially or fully complementary to an ASGR1 mRNA sequence comprises at least 15 contiguous nucleotides from a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639.

The sense strand of the RNAi construct typically comprises a sequence that is sufficiently complementary to the sequence of the antisense strand such that the two strands hybridize under physiological conditions to form a duplex region. A "duplex region" refers to the region in two complementary or substantially complementary polynucleotides that form base pairs with one another, either by Watson-Crick base pairing or other hydrogen bonding interaction, to create a duplex between the two polynucleotides. The duplex region of the RNAi construct should be of sufficient length to allow the RNAi construct to enter the RNA interference pathway, e.g. by engaging the Dicer enzyme and/or the RISC complex. For instance, in some embodiments, the duplex region is about 15 to about 30 base pairs in length. Other lengths for the duplex region within this range are also suitable, such as about 15 to about 28 base pairs, about 15 to about 26 base pairs, about 15 to about 24 base pairs, about 15 to about 22 base pairs, about 17 to about 28 base pairs, about 17 to about 26 base pairs, about 17 to about 24 base pairs, about 17 to about 23 base pairs, about 17 to about 21 base pairs, about 19 to about 25 base pairs, about 19 to about 23 base pairs, or about 19 to about 21 base pairs. In one embodiment, the duplex region is about 17 to about 24 base pairs in length. In another embodiment, the duplex region is about 19 to about 21 base pairs in length.

For embodiments in which the sense strand and antisense strand are two separate molecules (e.g. RNAi construct comprises a siRNA), the sense strand and antisense strand need not be the same length as the length of the duplex region. For instance, one or both strands may be longer than the duplex region and have one or more unpaired nucleotides or mismatches flanking the duplex region. Thus, in some embodiments, the RNAi construct comprises at least one nucleotide overhang. As used herein, a "nucleotide overhang" refers to the unpaired nucleotide or nucleotides that extend beyond the duplex region at the terminal ends of the strands. Nucleotide overhangs are typically created when the 3' end of one strand extends beyond the 5' end of the other strand or when the 5' end of one strand extends beyond the 3' end of the other strand. The length of a nucleotide overhang is generally between 1 and 6 nucleotides, 1 and 5 nucleotides, 1 and 4 nucleotides, 1 and 3 nucleotides, 2 and 6 nucleotides, 2 and 5 nucleotides, or 2 and 4 nucleotides. In some embodiments, the nucleotide overhang comprises 1, 2, 3, 4, 5, or 6 nucleotides. In one particular embodiment, the nucleotide overhang comprises 1 to 4 nucleotides. In certain embodiments, the nucleotide overhang comprises 2 nucleotides. The nucleotides in the overhang can be ribonucleotides, deoxyribonucleotides, or modified nucleotides as described herein. In some embodiments, the overhang comprises a 5'-uridine-uridine-3' (5'-UU-3') dinucleotide. In such embodiments, the UU dinucleotide may comprise ribonucleotides or modified nucleotides, e.g. 2'-modified nucleotides. In other embodiments, the overhang comprises a 5'-deoxythymidine-deoxythymidine-3' (5'-dTdT-3') dinucleotide.

The nucleotide overhang can be at the 5' end or 3' end of one or both strands. For example, in one embodiment, the RNAi construct comprises a nucleotide overhang at the 5' end and the 3' end of the antisense strand. In another embodiment, the RNAi construct comprises a nucleotide overhang at the 5' end and the 3' end of the sense strand. In some embodiments, the RNAi construct comprises a nucleotide overhang at the 5' end of the sense strand and the 5' end of the antisense strand. In other embodiments, the RNAi construct comprises a nucleotide overhang at the 3' end of the sense strand and the 3' end of the antisense strand.

The RNAi constructs may comprise a single nucleotide overhang at one end of the double-stranded RNA molecule and a blunt end at the other. A "blunt end" means that the sense strand and antisense strand are fully base-paired at the end of the molecule and there are no unpaired nucleotides that extend beyond the duplex region. In some embodiments, the RNAi construct comprises a nucleotide overhang at the 3' end of the sense strand and a blunt end at the 5' end of the sense strand and 3' end of the antisense strand. In other embodiments, the RNAi construct comprises a nucleotide overhang at the 3' end of the antisense strand and a blunt end at the 5' end of the antisense strand and the 3' end of the sense strand. In certain embodiments, the RNAi construct comprises a blunt end at both ends of the double-stranded RNA molecule. In such embodiments, the sense strand and antisense strand have the same length and the duplex region is the same length as the sense and antisense strands (i.e. the molecule is double-stranded over its entire length).

The sense strand and antisense strand can each independently be about 15 to about 30 nucleotides in length, about 18 to about 28 nucleotides in length, about 19 to about 27 nucleotides in length, about 19 to about 25 nucleotides in length, about 19 to about 23 nucleotides in length, about 21 to about 25 nucleotides in length, or about 21 to about 23 nucleotides in length. In certain embodiments, the sense strand and antisense strand are each about 18, about 19, about 20, about 21, about 22, about 23, about 24, or about 25 nucleotides in length. In some embodiments, the sense strand and antisense strand have the same length but form a duplex region that is shorter than the strands such that the RNAi construct has two nucleotide overhangs. For instance, in one embodiment, the RNAi construct comprises (i) a sense strand and an antisense strand that are each 21 nucleotides in length, (ii) a duplex region that is 19 base pairs in length, and (iii) nucleotide overhangs of 2 unpaired nucleotides at both the 3' end of the sense strand and the 3' end of the antisense strand. In another embodiment, the RNAi construct comprises (i) a sense strand and an antisense strand that are each 23 nucleotides in length, (ii) a duplex region that is 21 base pairs in length, and (iii) nucleotide overhangs of 2 unpaired nucleotides at both the 3' end of the sense strand and the 3' end of the antisense strand. In other embodiments, the sense strand and antisense strand have the same length and form a duplex region over their entire length such that there are no nucleotide overhangs on either end of the double-stranded molecule. In one such embodiment, the RNAi construct is blunt ended and comprises (i) a sense strand and an antisense strand, each of which is 21 nucleotides in length, and (ii) a duplex region that is 21 base pairs in length. In another such embodiment, the RNAi construct is blunt ended and comprises (i) a sense strand and an antisense strand, each of which is 23 nucleotides in length, and (ii) a duplex region that is 23 base pairs in length.

In other embodiments, the sense strand or the antisense strand is longer than the other strand and the two strands form a duplex region having a length equal to that of the shorter strand such that the RNAi construct comprises at least one nucleotide overhang. For example, in one embodiment, the RNAi construct comprises (i) a sense strand that is 19 nucleotides in length, (ii) an antisense strand that is 21 nucleotides in length, (iii) a duplex region of 19 base pairs in length, and (iv) a single nucleotide overhang of 2 unpaired nucleotides at the 3' end of the antisense strand. In another embodiment, the RNAi construct comprises (i) a sense strand that is 21 nucleotides in length, (ii) an antisense strand that is 23 nucleotides in length, (iii) a duplex region of 21 base pairs in length, and (iv) a single nucleotide overhang of 2 unpaired nucleotides at the 3' end of the antisense strand.

The antisense strand of the RNAi constructs of the invention can comprise the sequence of any one of the antisense sequences listed in Table 1, Table 6, or Table 8, the sequence of nucleotides 1-19 of any of these antisense sequences, or the sequence of nucleotides 2-19 of any of these antisense sequences. Each of the antisense sequences listed in Tables 1, 6, and 8 comprises a sequence of at least 19 consecutive nucleotides (first 19 nucleotides counting from the 5' end) that is complementary to an ASGR1 mRNA sequence plus a two nucleotide overhang sequence. Thus, in some embodiments, the antisense strand comprises a sequence of nucleotides 1-19 of any one of SEQ ID NOs: 1508-3010, 3665-4315, or 4513-4687. In other embodiments, the antisense strand comprises a sequence of nucleotides 2-19 of any one of SEQ ID NOs: 1508-3010, 3665-4315, or 4513-4687. In still other embodiments, the antisense strand comprises a sequence selected from SEQ ID NOs: 1508-3010, 3665-4315, or 4513-4687. In certain embodiments, the antisense strand comprises, or consists of, a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639. In some embodiments, the antisense strand comprises, or consists of, a sequence selected from SEQ ID NO: 1684, SEQ ID NO: 1708, SEQ ID NO: 1714, SEQ ID NO: 1743, SEQ ID NO: 2323, SEQ ID NO: 2650, SEQ ID NO: 2651, SEQ ID NO: 2867, SEQ ID NO: 2869, SEQ ID NO: 2873, SEQ ID NO: 4618, SEQ ID NO: 4621, SEQ ID NO: 4627, SEQ ID NO: 4638, or SEQ ID NO: 4639. In other embodiments, the antisense strand comprises, or consists of, a sequence selected from SEQ ID NO: 1743, SEQ ID NO: 2323, SEQ ID NO: 2651, SEQ ID NO: 2867, SEQ ID NO: 2869, SEQ ID NO: 4621, or SEQ ID NO: 4638.

In these and other embodiments, the sense strand of the RNAi constructs of the invention can comprise the sequence of any one of the sense sequences listed in Table 1, Table 6, or Table 8, the sequence of nucleotides 1-19 of any of these sense sequences, or the sequence of nucleotides 2-19 of any of these sense sequences. Each of the sense sequences listed in Tables 1, 6, and 8 comprises a sequence of at least 19 consecutive nucleotides (first 19 nucleotides counting from the 5' end) that is identical to an ASGR1 mRNA sequence and complementary to the corresponding antisense sequence, plus a two nucleotide overhang sequence. Thus, in some embodiments, the sense strand comprises a sequence of nucleotides 1-19 of any one of SEQ ID NOs: 5-1507, 3014-3664, or 4319-4512. In other embodiments, the sense strand comprises a sequence of nucleotides 2-19 of any one of SEQ ID NOs: 5-1507, 3014-3664, or 4319-4512. In still other embodiments, the sense strand comprises a sequence selected from SEQ ID NOs: 5-1507, 3014-3664, or 4319-4512. In certain embodiments, the sense strand comprises, or consists of, a sequence selected from SEQ ID NO: 103, SEQ ID NO: 181, SEQ ID NO: 205, SEQ ID NO: 211, SEQ ID NO: 240, SEQ ID NO: 251, SEQ ID NO: 378, SEQ ID NO: 394, SEQ ID NO: 818, SEQ ID NO: 820, SEQ ID NO: 988, SEQ ID NO: 1005, SEQ ID NO: 1050, SEQ ID NO: 1147, SEQ ID NO: 1148, SEQ ID NO: 443, SEQ ID NO: 499, SEQ ID NO: 1362, SEQ ID NO 1364, SEQ ID NO: 1366, SEQ ID NO: 1370, SEQ ID NO: 1466, SEQ ID NO: 3050, SEQ ID NO: 3051, SEQ ID NO: 3065, SEQ ID NO: 3067, SEQ ID NO: 3071, SEQ ID NO: 4443, SEQ ID NO: 4444, SEQ ID NO: 4446, SEQ ID NO: 4452, SEQ ID NO: 4455, SEQ ID NO: 4459, SEQ ID NO: 4463, or SEQ ID NO: 4464. In certain other embodiments, the sense strand comprises, or consists of, a sequence selected from SEQ ID NO: 181, SEQ ID NO: 205, SEQ ID NO: 211, SEQ ID NO: 240, SEQ ID NO: 820, SEQ ID NO: 1147, SEQ ID NO: 1148, SEQ ID NO: 1364, SEQ ID NO: 1366, SEQ ID NO: 1370, SEQ ID NO: 4443, SEQ ID NO: 4446, SEQ ID NO: 4452, SEQ ID NO: 4463, or SEQ ID NO: 4464. In some embodiments, the sense strand comprises, or consists of, a sequence selected from SEQ ID NO: 240, SEQ ID NO: 820, SEQ ID NO: 1148, SEQ ID NO: 1364, SEQ ID NO: 1366, SEQ ID NO: 4446 or SEQ ID NO: 4463.

In certain embodiments of the invention, the RNAi constructs comprise (i) a sense strand comprising a sequence selected from SEQ ID NOs: 5-1507, 3014-3664, or 4319-4512, nucleotides 1-19 of any one of SEQ ID NOs: 5-1507, 3014-3664, or 4319-4512, or nucleotides 2-19 of any one of SEQ ID NOs: 5-1507, 3014-3664, or 4319-4512, and (ii) an antisense strand comprising a sequence selected from SEQ ID NOs: 1508-3010, 3665-4315, or 4513-4687, nucleotides 1-19 of any one of SEQ ID NOs: 1508-3010, 3665-4315, or 4513-4687, or nucleotides 2-19 of any one of SEQ ID NOs: 1508-3010, 3665-4315, or 4513-4687. In some embodiments, the RNAi constructs comprise (i) a sense strand comprising, or consisting of, a sequence selected from SEQ ID NO: 103, SEQ ID NO: 181, SEQ ID NO: 205, SEQ ID NO: 211, SEQ ID NO: 240, SEQ ID NO: 251, SEQ ID NO: 378, SEQ ID NO: 394, SEQ ID NO: 818, SEQ ID NO: 820, SEQ ID NO: 988, SEQ ID NO: 1005, SEQ ID NO: 1050, SEQ ID NO: 1147, SEQ ID NO: 1148, SEQ ID NO: 443, SEQ ID NO: 499, SEQ ID NO: 1362, SEQ ID NO 1364, SEQ ID NO: 1366, SEQ ID NO: 1370, SEQ ID NO: 1466, SEQ ID NO: 3050, SEQ ID NO: 3051, SEQ ID NO: 3065, SEQ ID NO: 3067, SEQ ID NO: 3071, SEQ ID NO: 4443, SEQ ID NO: 4444, SEQ ID NO: 4446, SEQ ID NO: 4452, SEQ ID NO: 4455, SEQ ID NO: 4459, SEQ ID NO: 4463, or SEQ ID NO: 4464 and (ii) an antisense strand comprising, or consisting of, a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639. In other embodiments, the RNAi constructs comprise (i) a sense strand comprising, or consisting of, a sequence selected from SEQ ID NO: 181, SEQ ID NO: 205, SEQ ID NO: 211, SEQ ID NO: 240, SEQ ID NO: 820, SEQ ID NO: 1147, SEQ ID NO: 1148, SEQ ID NO: 1364, SEQ ID NO: 1366, SEQ ID NO: 1370, SEQ ID NO: 4443, SEQ ID NO: 4446, SEQ ID NO: 4452, SEQ ID NO: 4463, or SEQ ID NO: 4464, and (ii) an antisense strand comprising, or consisting of, a sequence selected from SEQ ID NO: 1684, SEQ ID NO: 1708, SEQ ID NO: 1714, SEQ ID NO: 1743, SEQ ID NO: 2323, SEQ ID NO: 2650, SEQ ID NO: 2651, SEQ ID NO: 2867, SEQ ID NO: 2869, SEQ ID NO: 2873, SEQ ID NO: 4618, SEQ ID NO: 4621, SEQ ID NO: 4627, SEQ ID NO: 4638, or SEQ ID NO: 4639. In still other embodiments, the RNAi constructs comprise (i) a sense strand comprising, or consisting of, a sequence selected from SEQ ID NO: 240, SEQ ID NO: 820, SEQ ID NO: 1148, SEQ ID NO: 1364, SEQ ID NO: 1366, SEQ ID NO: 4446 or SEQ ID NO: 4463, and (ii) an antisense strand comprising, or consisting of, a sequence selected from SEQ ID NO: 1743, SEQ ID NO: 2323, SEQ ID NO: 2651, SEQ ID NO: 2867, SEQ ID NO: 2869, SEQ ID NO: 4621, or SEQ ID NO: 4638.

In certain embodiments, the RNAi constructs comprise: (a) a sense strand comprising the sequence of SEQ ID NO: 181 and an antisense strand comprising the sequence of SEQ ID NO: 1684; (b) a sense strand comprising the sequence of SEQ ID NO: 205 and an antisense strand comprising the sequence of SEQ ID NO: 1708; (c) a sense strand comprising the sequence of SEQ ID NO: 211 and an antisense strand comprising the sequence of SEQ ID NO: 1714; (d) a sense strand comprising the sequence of SEQ ID NO: 240 and an antisense strand comprising the sequence of SEQ ID NO: 1743; (e) a sense strand comprising the sequence of SEQ ID NO: 820 and an antisense strand comprising the sequence of SEQ ID NO: 2323; (f) a sense strand comprising the sequence of SEQ ID NO: 1147 and an antisense strand comprising the sequence of SEQ ID NO: 2650; (g) a sense strand comprising the sequence of SEQ ID NO: 1148 and an antisense strand comprising the sequence of SEQ ID NO: 2651; (h) a sense strand comprising the sequence of SEQ ID NO: 1364 and an antisense strand comprising the sequence of SEQ ID NO: 2867; (i) a sense strand comprising the sequence of SEQ ID NO: 1366 and an antisense strand comprising the sequence of SEQ ID NO: 2869; or (j) a sense strand comprising the sequence of SEQ ID NO: 1370 and an antisense strand comprising the sequence of SEQ ID NO: 2873.

The RNAi construct of the invention can be any of the duplex compounds listed in Tables 1 to 10 (including the nucleotide sequences and/or chemical modifications of the compounds). In some embodiments, the RNAi construct is any of the duplex compounds listed in Table 1. In other embodiments, the RNAi construct is any of the duplex compounds listed in Table 6 (including the nucleotide sequences and/or chemical modifications of the compounds). In still other embodiments, the RNAi construct is any of the duplex compounds listed in Table 8 (including the nucleotide sequences and/or chemical modifications of the compounds). In certain embodiments, the RNAi construct is D-1098, D-1176, D-1200, D-1206, D-1235, D-1246, D-1373, D-1389, D-1813, D-1815, D-1983, D-2000, D-2045, D-2142, D-2143, D-1438, D-1494, D-2357, D-2359, D-2361, D-2365, D-2461, D-3036, D-3037, D-3051, D-3053, D-3057, D-3779, D-3780, D-3782, D-3788, D-3791, D-3795, D-3799, or D-3800. In some embodiments, the RNAi construct is D-1200, D-1206, D-1235, D-1815, D-2143, D-2359, D-2361, D-2365, D-2142, D-1176, D-3779, D-3782, D-3788, D-3799, or D-3800. In one particular embodiment, the RNAi construct is D-1235. In another particular embodiment, the RNAi construct is D-2143. In another embodiment, the RNAi construct is D-2361. In another embodiment, the RNAi construct is D-1815. In another embodiment, the RNAi construct is D-2359. In still another embodiment, the RNAi construct is D-3782. In yet another embodiment, the RNAi construct is D-3799.

In certain embodiments, the antisense strands of the RNAi constructs of the invention may target certain regions of the ASGR1 mRNA sequence. For instance, in some embodiments, the antisense strand of an RNAi construct of the invention comprises a sequence that is substantially complementary or fully complementary to nucleotides 692 to 721 of the human ASGR1 mRNA transcript set forth in SEQ ID NO: 1, nucleotides 692 to 716 of the human ASGR1 mRNA transcript set forth in SEQ ID NO: 1, or nucleotides 692 to 710 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 692 to 721, nucleotides 692 to 716, or nucleotides 692 to 710 of SEQ ID NO: 1.

In other embodiments, the antisense strand of an RNAi construct of the invention comprises a sequence that is substantially complementary or fully complementary to nucleotides 396 to 425 of the human ASGR1 mRNA transcript set forth in SEQ ID NO: 1, nucleotides 396 to 420 of the human ASGR1 mRNA transcript set forth in SEQ ID NO: 1, or nucleotides 396 to 414 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 396 to 425, nucleotides 396 to 420, or nucleotides 396 to 414 of SEQ ID NO: 1.

In still other embodiments, the antisense strand of an RNAi construct of the invention comprises a sequence that is substantially complementary or fully complementary to nucleotides 886 to 915 of the human ASGR1 mRNA transcript set forth in SEQ ID NO: 1, nucleotides 886 to 910 of the human ASGR1 mRNA transcript set forth in SEQ ID NO: 1, or nucleotides 886 to 904 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 886 to 915, nucleotides 886 to 910, or nucleotides 886 to 904 of SEQ ID NO: 1.

The RNAi constructs of the invention may comprise one or more modified nucleotides. A "modified nucleotide" refers to a nucleotide that has one or more chemical modifications to the nucleoside, nucleobase, pentose ring, or phosphate group. As used herein, modified nucleotides do not encompass ribonucleotides containing adenosine monophosphate, guanosine monophosphate, uridine monophosphate, and cytidine monophosphate, and deoxyribonucleotides containing deoxyadenosine monophosphate, deoxyguanosine monophosphate, deoxythymidine monophosphate, and deoxycytidine monophosphate. However, the RNAi constructs may comprise combinations of modified nucleotides, ribonucleotides, and deoxyribonucleotides. Incorporation of modified nucleotides into one or both strands of double-stranded RNA molecules can improve the in vivo stability of the RNA molecules, e.g., by reducing the molecules' susceptibility to nucleases and other degradation processes. The potency of RNAi constructs for reducing expression of the target gene can also be enhanced by incorporation of modified nucleotides.

In certain embodiments, the modified nucleotides have a modification of the ribose sugar. These sugar modifications can include modifications at the 2' and/or 5' position of the pentose ring as well as bicyclic sugar modifications. A 2'-modified nucleotide refers to a nucleotide having a pentose ring with a substituent at the 2' position other than H or OH. Such 2'-modifications include, but are not limited to, 2'-O-alkyl (e.g. O—$C_1$-$C_{10}$ or O—$C_1$-$C_{10}$ substituted alkyl), 2'-O-allyl (O—$CH_2CH$═$CH_2$), 2'-C-allyl, 2'-fluoro, 2'-O-methyl ($OCH_3$), 2'-O-methoxyethyl (O—$(CH_2)_2OCH_3$), 2'-$OCF_3$, 2'-$O(CH_2)_2SCH_3$, 2'-O-aminoalkyl, 2'-amino (e.g. $NH_2$), 2'-O-ethylamine, and 2'-azido. Modifications at the 5' position of the pentose ring include, but are not limited to, 5'-methyl (R or S); 5'-vinyl, and 5'-methoxy.

A "bicyclic sugar modification" refers to a modification of the pentose ring where a bridge connects two atoms of the ring to form a second ring resulting in a bicyclic sugar structure. In some embodiments the bicyclic sugar modification comprises a bridge between the 4' and 2' carbons of the pentose ring. Nucleotides comprising a sugar moiety with a bicyclic sugar modification are referred to herein as bicyclic nucleic acids or BNAs. Exemplary bicyclic sugar modifications include, but are not limited to, α-L-Methyleneoxy (4'-$CH_2$—O-2') bicyclic nucleic acid (BNA); β-D-Methyleneoxy (4'-$CH_2$—O-2') BNA (also referred to as a locked nucleic acid or LNA); Ethyleneoxy (4'-$(CH_2)_2$—O-2') BNA; Aminooxy (4'-$CH_2$—O—N(R)-2') BNA; Oxyamino (4'-$CH_2$—N(R)—O-2') BNA; Methyl (methyleneoxy) (4'-$CH(CH_3)$—O-2') BNA (also referred to as constrained ethyl or cEt); methylene-thio (4'-$CH_2$—S-2') BNA; methylene-amino (4'-CH2-N(R)-2') BNA; methyl carbocyclic (4'-$CH_2$—$CH(CH_3)$-2') BNA; propylene carbocyclic (4'-$(CH_2)_3$-2') BNA; and Methoxy (ethyleneoxy) (4'-CH ($CH_2OMe$)—O-2') BNA (also referred to as constrained MOE or cMOE). These and other sugar-modified nucleotides that can be incorporated into the RNAi constructs of the invention are described in U.S. Pat. No. 9,181,551, U.S. Patent Publication No. 2016/0122761, and Deleavey and Damha, Chemistry and Biology, Vol. 19:937-954, 2012, all of which are hereby incorporated by reference in their entireties.

In some embodiments, the RNAi constructs comprise one or more 2'-fluoro modified nucleotides, 2'-O-methyl modified nucleotides, 2'-O-methoxyethyl modified nucleotides, 2'-O-allyl modified nucleotides, bicyclic nucleic acids (BNAs), or combinations thereof. In certain embodiments, the RNAi constructs comprise one or more 2'-fluoro modified nucleotides, 2'-O-methyl modified nucleotides, 2'-O-methoxyethyl modified nucleotides, or combinations thereof. In one particular embodiment, the RNAi constructs comprise one or more 2'-fluoro modified nucleotides, 2'-O-methyl modified nucleotides or combinations thereof.

Both the sense and antisense strands of the RNAi constructs can comprise one or multiple modified nucleotides. For instance, in some embodiments, the sense strand comprises 1, 2, 3, 4, 5, 6, 7, 8, 9, 10 or more modified nucleotides. In certain embodiments, all nucleotides in the sense strand are modified nucleotides. In some embodiments, the antisense strand comprises 1, 2, 3, 4, 5, 6, 7, 8, 9, 10 or more modified nucleotides. In other embodiments, all nucleotides in the antisense strand are modified nucleotides. In certain other embodiments, all nucleotides in the sense strand and all nucleotides in the antisense strand are modified nucleotides. In these and other embodiments, the modified nucleotides can be 2'-fluoro modified nucleotides, 2'-O-methyl modified nucleotides, or combinations thereof.

In some embodiments, all pyrimidine nucleotides preceding an adenosine nucleotide in the sense strand, antisense strand, or both strands are modified nucleotides. For example, where the sequence 5'-CA-3' or 5'-UA-3' appears in either strand, the cytidine and uridine nucleotides are modified nucleotides, preferably 2'-O-methyl modified nucleotides. In certain embodiments, all pyrimidine nucleotides in the sense strand are modified nucleotides (e.g. 2'-O-methyl modified nucleotides), and the 5' nucleotide in all occurrences of the sequence 5'-CA-3' or 5'-UA-3' in the antisense strand are modified nucleotides (e.g. 2'-O-methyl modified nucleotides). In other embodiments, all nucleotides in the duplex region are modified nucleotides. In such embodiments, the modified nucleotides are preferably 2'-O-methyl modified nucleotides, 2'-fluoro modified nucleotides or combinations thereof.

In embodiments in which the RNAi construct comprises a nucleotide overhang, the nucleotides in the overhang can be ribonucleotides, deoxyribonucleotides, or modified nucleotides. In one embodiment, the nucleotides in the overhang are deoxyribonucleotides, e.g. deoxythymidine. In another embodiment, the nucleotides in the overhang are modified nucleotides. For instance, in some embodiments, the nucleotides in the overhang are 2'-O-methyl modified nucleotides, 2'-fluoro modified nucleotides, 2'-methoxyethyl modified nucleotides, or combinations thereof.

The RNAi constructs of the invention may also comprise one or more modified internucleotide linkages. As used herein, the term "modified internucleotide linkage" refers to an internucleotide linkage other than the natural 3' to 5' phosphodiester linkage. In some embodiments, the modified internucleotide linkage is a phosphorous-containing internucleotide linkage, such as a phosphotriester, aminoalkylphosphotriester, an alkylphosphonate (e.g. methylphosphonate, 3'-alkylene phosphonate), a phosphinate, a phosphoramidate (e.g. 3'-amino phosphoramidate and aminoalkylphosphoramidate), a phosphorothioate (P═S), a chiral phosphorothioate, a phosphorodithioate, a thionophosphoramidate, a thionoalkylphosphonate, a thionoalkylphosphotriester, and a boranophosphate. In one embodiment, a modified internucleotide linkage is a 2' to 5' phosphodiester linkage. In other embodiments, the modified internucleotide linkage is a non-phosphorous-containing internucleotide linkage and thus can be referred to as a modified internucleoside linkage. Such non-phosphorous-containing linkages include, but are not limited to, morpholino linkages (formed in part from the sugar portion of a nucleoside); siloxane linkages (—O—$Si(H)_2$—O—); sulfide, sulfoxide and sulfone linkages; formacetyl and thioformacetyl linkages; alkene containing backbones; sulfamate backbones; methylenemethylimino (—$CH_2$—N($CH_3$)—O—$CH_2$—) and methylenehydrazino linkages; sulfonate and sulfonamide linkages; amide linkages; and others having mixed N, O, S and $CH_2$ component parts. In one embodiment, the modified internucleoside linkage is a peptide-based linkage (e.g. aminoethylglycine) to create a peptide nucleic acid or PNA, such as those described in U.S. Pat. Nos. 5,539,082; 5,714,331; and 5,719,262. Other suitable modified internucleotide and internucleoside linkages that may be employed in the RNAi constructs of the invention are described in U.S. Pat. Nos. 6,693,187, 9,181,551, U.S. Patent Publication No. 2016/0122761, and Deleavey and Damha, Chemistry and Biology, Vol. 19:937-954, 2012, all of which are hereby incorporated by reference in their entireties.

In certain embodiments, the RNAi constructs comprise one or more phosphorothioate internucleotide linkages. The phosphorothioate internucleotide linkages may be present in the sense strand, antisense strand, or both strands of the RNAi constructs. For instance, in some embodiments, the sense strand comprises 1, 2, 3, 4, 5, 6, 7, 8, or more phosphorothioate internucleotide linkages. In other embodiments, the antisense strand comprises 1, 2, 3, 4, 5, 6, 7, 8, or more phosphorothioate internucleotide linkages. In still other embodiments, both strands comprise 1, 2, 3, 4, 5, 6, 7, 8, or more phosphorothioate internucleotide linkages. The RNAi constructs can comprise one or more phosphorothioate internucleotide linkages at the 3'-end, the 5'-end, or both the 3'- and 5'-ends of the sense strand, the antisense strand, or both strands. For instance, in certain embodiments, the RNAi construct comprises about 1 to about 6 or more (e.g., about 1, 2, 3, 4, 5, 6 or more) consecutive phosphorothioate internucleotide linkages at the 3'-end of the sense strand, the antisense strand, or both strands. In other embodiments, the RNAi construct comprises about 1 to about 6 or more (e.g., about 1, 2, 3, 4, 5, 6 or more) consecutive phosphorothioate internucleotide linkages at the 5'-end of the sense strand, the antisense strand, or both strands. In one embodiment, the RNAi construct comprises a single phosphorothioate internucleotide linkage at the 3' end of the sense strand and a single phosphorothioate internucleotide linkage at the 3' end of the antisense strand. In another embodiment, the RNAi construct comprises two consecutive phosphorothioate internucleotide linkages at the 3' end of the antisense strand (i.e. a phosphorothioate internucleotide linkage at the first and second internucleotide linkages at the 3' end of the antisense strand). In another embodiment, the RNAi construct comprises two consecutive phosphorothioate internucleotide linkages at both the 3' and 5' ends of the antisense strand. In yet another embodiment, the RNAi construct comprises two consecutive phosphorothioate internucleotide linkages at both the 3' and 5' ends of the antisense strand and two consecutive phosphorothioate internucleotide linkages at the 5' end of the sense strand. In still another embodiment, the RNAi construct comprises two consecutive phosphorothioate internucleotide linkages at both the 3' and 5' ends of the antisense strand and two consecutive phosphorothioate internucleotide linkages at both the 3' and 5' ends of the sense strand (i.e. a phosphorothioate internucleotide linkage at the first and second internucleotide linkages at both the 5' and 3' ends of the antisense strand and a phosphorothioate internucleotide linkage at the first and second internucleotide linkages at both the 5' and 3' ends of the sense strand). In any of the embodiments in which one or both strands comprises one or more phosphorothioate internucleotide linkages, the remaining internucleotide linkages within the strands can be the natural 3' to 5' phosphodiester linkages. For instance, in some embodiments, each internucleotide linkage of the sense and antisense strands is selected from phosphodiester and phosphorothioate, wherein at least one internucleotide linkage is a phosphorothioate.

In embodiments in which the RNAi construct comprises a nucleotide overhang, two or more of the unpaired nucleotides in the overhang can be connected by a phosphorothioate internucleotide linkage. In certain embodiments, all the unpaired nucleotides in a nucleotide overhang at the 3' end of the antisense strand and/or the sense strand are connected by phosphorothioate internucleotide linkages. In other embodiments, all the unpaired nucleotides in a nucleotide overhang at the 5' end of the antisense strand and/or the sense strand are connected by phosphorothioate internucleotide linkages. In still other embodiments, all the unpaired nucleotides in any nucleotide overhang are connected by phosphorothioate internucleotide linkages.

In certain embodiments, the modified nucleotides incorporated into one or both of the strands of the RNAi constructs of the invention have a modification of the nucleobase (also referred to herein as "base"). A "modified nucleobase" or "modified base" refers to a base other than the naturally occurring purine bases adenine (A) and guanine (G) and pyrimidine bases thymine (T), cytosine (C), and uracil (U). Modified nucleobases can be synthetic or naturally occurring modifications and include, but are not limited to, universal bases, 5-methylcytosine (5-me-C), 5-hydroxymethyl cytosine, xanthine (X), hypoxanthine (I), 2-aminoadenine, 6-methyladenine, 6-methylguanine, and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine.

In some embodiments, the modified base is a universal base. A "universal base" refers to a base analog that indiscriminately forms base pairs with all of the natural bases in RNA and DNA without altering the double helical structure of the resulting duplex region. Universal bases are known to those of skill in the art and include, but are not limited to, inosine, C-phenyl, C-naphthyl and other aromatic derivatives, azole carboxamides, and nitroazole derivatives, such as 3-nitropyrrole, 4-nitroindole, 5-nitroindole, and 6-nitroindole.

Other suitable modified bases that can be incorporated into the RNAi constructs of the invention include those described in Herdewijn, Antisense Nucleic Acid Drug Dev., Vol. 10:297-310, 2000 and Peacock et al., J. Org. Chem., Vol. 76:7295-7300, 2011, both of which are hereby incorporated by reference in their entireties. The skilled person is well aware that guanine, cytosine, adenine, thymine, and uracil may be replaced by other nucleobases, such as the modified nucleobases described above, without substantially altering the base pairing properties of a polynucleotide comprising a nucleotide bearing such replacement nucleobase.

In some embodiments, the sense and antisense strands of the RNAi constructs may comprise one or more abasic nulceotides. An "abasic nucleotide" or "abasic nucleoside" is a nucleotide or nucleoside that lacks a nucleobase at the 1' position of the ribose sugar. In certain embodiments, the abasic nucleotides are incorporated into the terminal ends of the sense and/or antisense strands of the RNAi constructs. In one embodiment, the sense strand comprises an abasic nucleotide as the terminal nucleotide at its 3' end, its 5' end, or both its 3' and 5' ends. In another embodiment, the antisense strand comprises an abasic nucleotide as the terminal nucleotide at its 3' end, its 5' end, or both its 3' and 5' ends. In such embodiments in which the abasic nucleotide is a terminal nucleotide, it may be linked to the adjacent nucleotide through a 3'-3' internucleotide linkage (i.e. an inverted nucleotide) rather than the natural 3'-5' internucleotide linkage.

In some embodiments of the RNAi constructs of the invention, the 5' end of the sense strand, antisense strand, or both the antisense and sense strands comprises a phosphate moiety. As used herein, the term "phosphate moiety" refers to a terminal phosphate group that includes unmodified phosphates (—O—P═O)(OH)OH) as well as modified phosphates. Modified phosphates include phosphates in which one or more of the O and OH groups is replaced with H, O, S, N(R) or alkyl where R is H, an amino protecting group or unsubstituted or substituted alkyl. Exemplary phosphate moieties include, but are not limited to, 5'-monophosphate; 5'-diphosphate; 5'-triphosphate; 5'-guanosine cap (7-methylated or non-methylated); 5'-adenosine cap or any other modified or unmodified nucleotide cap structure; 5'-monothiophosphate (phosphorothioate); 5'-monodithiophosphate (phosphorodithioate); 5'-alpha-thiotriphosphate; 5'-gamma-thiotriphosphate, 5'-phosphoramidates; 5'-vinylphosphates; 5'-alkylphosphonates (e.g., alkyl=methyl, ethyl, isopropyl, propyl, etc.); and 5'-alkyletherphosphonates (e.g., alkylether=methoxymethyl, ethoxymethyl, etc.).

The modified nucleotides that can be incorporated into the RNAi constructs of the invention may have more than one chemical modification described herein. For instance, the modified nucleotide may have a modification to the ribose sugar as well as a modification to the nucleobase. By way of example, a modified nucleotide may comprise a 2' sugar modification (e.g. 2'-fluoro or 2'-methyl) and comprise a modified base (e.g. 5-methyl cytosine or pseudouracil). In other embodiments, the modified nucleotide may comprise a sugar modification in combination with a modification to the 5' phosphate that would create a modified internucleotide or internucleoside linkage when the modified nucleotide was incorporated into a polynucleotide. For instance, in some embodiments, the modified nucleotide may comprise a sugar modification, such as a 2'-fluoro modification, a 2'-O-methyl modification, or a bicyclic sugar modification, as well as a 5' phosphorothioate group. Accordingly, in some embodiments, one or both strands of the RNAi constructs of the invention comprise a combination of 2' modified nucleotides or BNAs and phosphorothioate internucleotide linkages. In certain embodiments, both the sense and antisense strands of the RNAi constructs of the invention comprise a combination of 2'-fluoro modified nucleotides, 2'-O-methyl modified nucleotides, and phosphorothioate internucleotide linkages. Exemplary RNAi constructs comprising modified nucleotides and internucleotide linkages are shown in Tables 6 and 8.

Preferably, the RNAi constructs of the invention reduce or inhibit the expression of ASGR1 in cells, particularly liver cells. Accordingly, in one embodiment, the present invention provides a method of reducing ASGR1 expression in a cell by contacting the cell with any RNAi construct described herein. The cell may be in vitro or in vivo. ASGR1 expression can be assessed by measuring the amount or level of ASGR1 mRNA, ASGR1 protein, or another biomarker linked to ASGR1 expression, such as serum levels of alkaline phosphatase. The reduction of ASGR1 expression in cells or animals treated with an RNAi construct of the invention can be determined relative to the ASGR1 expression in cells or animals not treated with the RNAi construct or treated with a control RNAi construct. For instance, in some embodiments, reduction of ASGR1 expression is assessed by (a) measuring the amount or level of ASGR1 mRNA in liver cells treated with a RNAi construct of the invention, (b) measuring the amount or level of ASGR1 mRNA in liver cells treated with a control RNAi construct (e.g. RNAi agent directed to a RNA molecule not expressed in liver cells or a RNAi construct having a nonsense or scrambled sequence) or no construct, and (c) comparing the measured ASGR1 mRNA levels from treated cells in (a) to the measured ASGR1 mRNA levels from control cells in (b). The ASGR1 mRNA levels in the treated cells and controls cells can be normalized to RNA levels for a control gene (e.g. 18S ribosomal RNA or housekeeping gene) prior to comparison. ASGR1 mRNA levels can be measured by a variety of methods, including Northern blot analysis, nuclease protection assays, fluorescence in situ hybridization (FISH), reverse-transcriptase (RT)-PCR, real-time RT-PCR, quantitative PCR, droplet digital PCR, and the like.

In other embodiments, reduction of ASGR1 expression is assessed by (a) measuring the amount or level of ASGR1 protein in liver cells treated with a RNAi construct of the invention, (b) measuring the amount or level of ASGR1 protein in liver cells treated with a control RNAi construct (e.g. RNAi agent directed to a RNA molecule not expressed in liver cells or a RNAi construct having a nonsense or scrambled sequence) or no construct, and (c) comparing the measured ASGR1 protein levels from treated cells in (a) to the measured ASGR1 protein levels from control cells in (b). Methods of measuring ASGR1 protein levels are known to those of skill in the art, and include Western Blots, immunoassays (e.g. ELISA), and flow cytometry. An exemplary immunoassay-based method for assessing ASGR1 protein expression is described in Examples 2 and 7. Example 3 describes an exemplary method for measuring ASGR1 mRNA using RNA FISH, and Example 8 describes an exemplary method for assessing ASGR1 mRNA using droplet digital PCR. Any method capable of measuring ASGR1 mRNA or protein can be used to assess the efficacy of the RNAi constructs of the invention.

In some embodiments, the methods to assess ASGR1 expression levels are performed in vitro in cells that natively express ASGR1 (e.g. liver cells) or cells that have been engineered to express ASGR1. In certain embodiments, the methods are performed in vitro in liver cells. Suitable liver cells include, but are not limited to, primary hepatocytes (e.g. human, non-human primate, or rodent hepatocytes), HepAD38 cells, HuH-6 cells, HuH-7 cells, HuH-5-2 cells, BNLCL2 cells, Hep3B cells, or HepG2 cells. In one embodiment, the liver cells are Hep3B cells. In another embodiment, the liver cells are human primary hepatopyctes.

In other embodiments, the methods to assess ASGR1 expression levels are performed in vivo. The RNAi constructs and any control RNAi constructs can be administered to an animal (e.g. rodent or non-human primate) and ASGR1 mRNA or protein levels assessed in liver tissue harvested from the animal following treatment. Alternatively or additionally, a biomarker or functional phenotype associated with ASGR1 expression can be assessed in the treated animals. For instance, elevated serum alkaline phosphatase levels correlate with reduced serum levels of non-HDL cholesterol in individuals with loss of function mutations in the ASGR1 gene (Nioi et al., New England Journal of Medicine, Vol. 374 (22): 2131-2141, 2016, which is hereby incorporated by reference in its entirety). Thus, serum levels of alkaline phosphatase or non-HDL cholesterol can be measured in animals treated with RNAi constructs of the invention to assess the functional efficacy of reducing ASGR1 expression. Exemplary methods for these analyses are described in Examples 6, 9, and 10.

In certain embodiments, expression of ASGR1 is reduced in liver cells by at least 10%, at least 15%, at least 20%, at least 25%, at least 30%, at least 35%, at least 40%, at least 45%, or at least 50% by an RNAi construct of the invention. In some embodiments, expression of ASGR1 is reduced in liver cells by at least 60%, at least 65%, at least 70%, at least 75%, at least 80%, or at least 85% by an RNAi construct of the invention. In other embodiments, the expression of ASGR1 is reduced in liver cells by about 90% or more, e.g., 91%, 92%, 93%, 94%, 95%, 96%, 97%, 98%, 99%, or more by an RNAi construct of the invention. The percent reduction of ASGR1 expression can be measured by any of the methods described herein as well as others known in the art. For instance, in certain embodiments, the RNAi constructs of the invention inhibit at least 45% of ASGR1 expression at 5 nM in Hep3B cells in vitro. In related embodiments, the RNAi constructs of the invention inhibit at least 50%, at least 55%, at least 60%, at least 65%, at least 70%, or at least 75% of ASGR1 expression at 5 nM in Hep3B cells in vitro.

In other embodiments, the RNAi constructs of the invention inhibit at least 80%, at least 85%, at least 90%, at least 92%, at least 94%, at least 96%, or at least 98% of ASGR1 expression at 5 nM in Hep3B cells in vitro.

In some embodiments, an IC50 value is calculated to assess the potency of an RNAi construct of the invention for inhibiting ASGR1 expression in liver cells. An "IC50 value" is the dose/concentration required to achieve 50% inhibition of a biological or biochemical function. The IC50 value of any particular substance or antagonist can be determined by constructing a dose-response curve and examining the effect of different concentrations of the substance or antagonist on expression levels or functional activity in any assay. IC50 values can be calculated for a given antagonist or substance by determining the concentration needed to inhibit half of the maximum biological response or native expression levels. Thus, the IC50 value for any RNAi construct can be calculated by determining the concentration of the RNAi construct needed to inhibit half of the native ASGR1 expression level in liver cells (e.g. ASGR1 expression level in control liver cells) in any assay, such as the immunoassay, RNA FISH assay, qPCR or droplet digital PCR assays described in the Examples. The RNAi constructs of the invention may inhibit ASGR1 expression in liver cells (e.g. Hep3B cells) with an IC50 of less than about 10 nM, less than about 5 nM, or less than about 1 nM. For example, the RNAi constructs inhibit ASGR1 expression in liver cells with an IC50 of about 0.5 nM to about 10 nM, about 0.8 nM to about 8 nM, about 1 nM to about 5 nM, about 0.8 nM to about 3 nM, about 0.001 nM to about 1 nM, about 0.001 nM to about 0.50 nM, about 0.001 nM to about 0.1 nM, about 0.001 nM to about 0.01 nM, about 0.01 nM to about 0.50 nM, about 0.02 nM to about 0.80 nM, about 0.01 nM to about 1.0 nM, about 0.1 nM to about 0.9 nM, or about 0.05 nM to about 0.5 nM. In certain embodiments, the RNAi construct inhibits ASGR1 expression in liver cells (e.g. Hep3B cells) with an IC50 of about 0.5 nM to about 5 nM. In other embodiments, the RNAi construct inhibits ASGR1 expression in liver cells (e.g. Hep3B cells) with an IC50 of about 0.01 nM to about 0.9 nM.

The RNAi constructs of the invention can readily be made using techniques known in the art, for example, using conventional nucleic acid solid phase synthesis. The polynucleotides of the RNAi constructs can be assembled on a suitable nucleic acid synthesizer utilizing standard nucleotide or nucleoside precursors (e.g. phosphoramidites). Automated nucleic acid synthesizers are sold commercially by several vendors, including DNA/RNA synthesizers from Applied Biosystems (Foster City, CA), MerMade synthesizers from BioAutomation (Irving, TX), and OligoPilot synthesizers from GE Healthcare Life Sciences (Pittsburgh, PA).

The 2' silyl protecting group can be used in conjunction with acid labile dimethoxytrityl (DMT) at the 5' position of ribonucleosides to synthesize oligonucleotides via phosphoramidite chemistry. Final deprotection conditions are known not to significantly degrade RNA products. All syntheses can be conducted in any automated or manual synthesizer on large, medium, or small scale. The syntheses may also be carried out in multiple well plates, columns, or glass slides.

The 2'-O-silyl group can be removed via exposure to fluoride ions, which can include any source of fluoride ion, e.g., those salts containing fluoride ion paired with inorganic counterions e.g., cesium fluoride and potassium fluoride or those salts containing fluoride ion paired with an organic counterion, e.g., a tetraalkylammonium fluoride. A crown ether catalyst can be utilized in combination with the inorganic fluoride in the deprotection reaction. Preferred fluoride ion source are tetrabutylammonium fluoride or aminohydrofluorides (e.g., combining aqueous HF with triethylamine in a dipolar aprotic solvent, e.g., dimethylformamide).

The choice of protecting groups for use on the phosphite triesters and phosphotriesters can alter the stability of the triesters towards fluoride. Methyl protection of the phosphotriester or phosphitetriester can stabilize the linkage against fluoride ions and improve process yields.

Since ribonucleosides have a reactive 2' hydroxyl substituent, it can be desirable to protect the reactive 2' position in RNA with a protecting group that is orthogonal to a 5'-O-dimethoxytrityl protecting group, e.g., one stable to treatment with acid. Silyl protecting groups meet this criterion and can be readily removed in a final fluoride deprotection step that can result in minimal RNA degradation.

Tetrazole catalysts can be used in the standard phosphoramidite coupling reaction. Preferred catalysts include, e.g., tetrazole, S-ethyl-tetrazole, benzylthiotetrazole, p-nitrophenyltetrazole.

As can be appreciated by the skilled artisan, further methods of synthesizing the RNAi constructs described herein will be evident to those of ordinary skill in the art. Additionally, the various synthetic steps may be performed in an alternate sequence or order to give the desired compounds. Other synthetic chemistry transformations, protecting groups (e.g., for hydroxyl, amino, etc. present on the bases) and protecting group methodologies (protection and deprotection) useful in synthesizing the RNAi constructs described herein are known in the art and include, for example, those such as described in R. Larock, Comprehensive Organic Transformations, VCH Publishers (1989); T. W. Greene and P. G. M. Wuts, Protective Groups in Organic Synthesis, 2d. Ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof. Custom synthesis of RNAi agents is also available from several commercial vendors, including Dharmacon, Inc. (Lafayette, CO), AxoLabs GmbH (Kulmbach, Germany), and Ambion, Inc. (Foster City, CA).

The RNAi constructs of the invention may comprise a ligand. As used herein, a "ligand" refers to any compound or molecule that is capable of interacting with another compound or molecule, directly or indirectly. The interaction of a ligand with another compound or molecule may elicit a biological response (e.g. initiate a signal transduction cascade, induce receptor-mediated endocytosis) or may just be a physical association. The ligand can modify one or more properties of the double-stranded RNA molecule to which is attached, such as the pharmacodynamic, pharmacokinetic, binding, absorption, cellular distribution, cellular uptake, charge and/or clearance properties of the RNA molecule.

The ligand may comprise a serum protein (e.g., human serum albumin, low-density lipoprotein, globulin), a cholesterol moiety, a vitamin (biotin, vitamin E, vitamin $B_{12}$), a folate moiety, a steroid, a bile acid (e.g. cholic acid), a fatty acid (e.g., palmitic acid, myristic acid), a carbohydrate (e.g., a dextran, pullulan, chitin, chitosan, inulin, cyclodextrin or hyaluronic acid), a glycoside, a phospholipid, or antibody or binding fragment thereof (e.g. antibody or binding fragment that targets the RNAi construct to a specific cell type, such as liver). Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, 03-(oleoyl) lithocholic acid, 03-(oleoyl) cholenic acid, dimethoxytrityl, or phenoxazine), peptides (e.g., antennapedia peptide, Tat peptide, RGD peptides), alkylating agents, polymers, such as polyethylene glycol (PEG) (e.g., PEG-40K), polyamino acids, and polyamines (e.g. spermine, spermidine).

In certain embodiments, the ligands have endosomolytic properties. The endosomolytic ligands promote the lysis of the endosome and/or transport of the RNAi construct of the invention, or its components, from the endosome to the cytoplasm of the cell. The endosomolytic ligand may be a polycationic peptide or peptidomimetic, which shows pH-dependent membrane activity and fusogenicity. In one embodiment, the endosomolytic ligand assumes its active conformation at endosomal pH. The "active" conformation is that conformation in which the endosomolytic ligand promotes lysis of the endosome and/or transport of the RNAi construct of the invention, or its components, from the endosome to the cytoplasm of the cell. Exemplary endosomolytic ligands include the GALA peptide (Subbarao et al., Biochemistry, Vol. 26:2964-2972, 1987), the EALA peptide (Vogel et al., J. Am. Chem. Soc., Vol. 118:1581-1586, 1996), and their derivatives (Turk et al., Biochem. Biophys. Acta, Vol. 1559:56-68, 2002). In one embodiment, the endosomolytic component may contain a chemical group (e.g., an amino acid) which will undergo a change in charge or protonation in response to a change in pH. The endosomolytic component may be linear or branched.

In some embodiments, the ligand comprises a lipid or other hydrophobic molecule. In one embodiment, the ligand comprises a cholesterol moiety or other steroid. Cholesterol-conjugated oligonucleotides have been reported to be more active than their unconjugated counterparts (Manoharan, Antisense Nucleic Acid Drug Development, Vol. 12:103-228, 2002). Ligands comprising cholesterol moieties and other lipids for conjugation to nucleic acid molecules have also been described in U.S. Pat. Nos. 7,851,615; 7,745,608; and 7,833,992, all of which are hereby incorporated by reference in their entireties. In another embodiment, the ligand comprises a folate moiety. Polynucleotides conjugated to folate moieties can be taken up by cells via a receptor-mediated endocytosis pathway. Such folate-polynucleotide conjugates are described in U.S. Pat. No. 8,188,247, which is hereby incorporated by reference in its entirety.

Given that ASGR1 is expressed on the surface of liver cells (e.g. hepatocytes) as a component of the asialoglycoprotein receptor (ASGR), in certain embodiments, it is desirable to specifically deliver the RNAi construct to those liver cells. Accordingly, in certain embodiments, the ligand targets delivery of the RNAi constructs specifically to liver cells (e.g. hepatocytes) using various approaches as described in more detail below. In certain embodiments, the RNAi constructs are targeted to liver cells with a ligand that binds to the surface-expressed ASGR, ASGR1 and/or ASGR2. In these embodiments, it is envisioned that this targeting approach can result in a self-regulating system that reduces the amount of RNAi construct delivered to the liver cells as expression of ASGR1 is reduced due to the effect of the previously delivered RNAi construct.

In some embodiments, RNAi constructs can be specifically targeted to the liver by employing ligands that bind to or interact with proteins expressed on the surface of liver cells. For example, in certain embodiments, the ligands may comprise antigen binding proteins (e.g. antibodies or binding fragments thereof (e.g. Fab, scFv)) that specifically bind to a receptor expressed on hepatocytes, such as the asialoglycoprotein receptor and the LDL receptor. In one particular embodiment, the ligand comprises an antibody or binding fragment thereof that specifically binds to ASGR1 and/or ASGR2. In another embodiment, the ligand comprises a Fab fragment of an antibody that specifically binds to ASGR1 and/or ASGR2. A "Fab fragment" is comprised of one immunoglobulin light chain (i.e. light chain variable region (VL) and constant region (CL)) and the CH1 region and variable region (VH) of one immunoglobulin heavy chain. In another embodiment, the ligand comprises a single-chain variable antibody fragment (scFv fragment) of an antibody that specifically binds to ASGR1 and/or ASGR2. An "scFv fragment" comprises the VH and VL regions of an antibody, wherein these regions are present in a single polypeptide chain, and optionally comprising a peptide linker between the VH and VL regions that enables the Fv to form the desired structure for antigen binding. Exemplary antibodies and binding fragments thereof that specifically bind to ASGR1 that can be used as ligands for targeting the RNAi constructs of the invention to the liver are described in U.S. Patent Application No. 62/234,546 and WIPO Publication No. WO 2017/058944, both of which are hereby incorporated by reference in their entireties. Other antibodies or binding fragments thereof that specifically bind to ASGR1, LDL receptor, or other liver surface-expressed proteins suitable for use as ligands in the RNAi constructs of the invention are commercially available.

In some embodiments, the ligand comprises a cys monoclonal antibody (mAb) or antigen-binding fragment thereof. A "cys mAb" is a monoclonal antibody or antigen-binding fragment thereof in which at least one amino acid in the light chain or heavy chain has been substituted with a cysteine amino acid or at least one cysteine amino acid has been inserted into the primary sequence of the light chain or heavy chain. The free thiol group in the side chain of the cysteine amino acid provides a conjugation site to which the sense strand of the RNAi constructs of the invention can be covalently linked. The cysteine substitutions/additions can be at the amino-terminus or carboxy-terminus of the light chain or heavy chain of the antibody or antigen-binding fragment. Alternatively or additionally, the cysteine substitutions/additions can be located at an internal site within the light chain or heavy chain so long as the cysteine substitution/addition does not affect the binding affinity of the antibody or antigen-binding fragment to its target antigen (e.g. ASGR1). Exemplary amino acids within the heavy and light chains of antibodies that may be substituted with cysteine residues are described in WIPO Publication Nos. WO 2006/034488 and WO 2007/022070, both of which are hereby incorporated by reference in their entireties. In certain embodiments, the ligand comprises a cys mAb or antigen-binding fragment thereof that specifically binds to human ASGR1. An exemplary anti-ASGR1 cys mAb is described in Example 10. In one embodiment, the ligand comprises an anti-ASGR1 antibody having a heavy chain and a light chain, wherein the heavy chain comprises the sequence of SEQ ID NO: 4696 and the light chain comprises the sequence of SEQ ID NO: 4697. Anti-ASGR1 cys mAbs or antigen-binding fragments thereof may be covalently attached to the 5' end or 3' end of the sense strand of an RNAi construct of the invention, optionally through any of the linkers described herein. In some embodiments, the anti-ASGR1 antibody-RNA molecule conjugate comprises one copy of the interfering RNA molecule (e.g. siRNA or shRNA) (i.e. an RNAi-to-antibody ratio of 1). In other embodiments, the anti-ASGR1 antibody-RNA molecule conjugate comprises two copies of the interfering RNA molecule (e.g. siRNA or shRNA) (i.e. an RNAi-to-antibody ratio of 2).

In certain embodiments, the ligand comprises a carbohydrate. A "carbohydrate" refers to a compound made up of one or more monosaccharide units having at least 6 carbon atoms (which can be linear, branched or cyclic) with an oxygen, nitrogen or sulfur atom bonded to each carbon atom. Carbohydrates include, but are not limited to, the sugars (e.g., monosaccharides, disaccharides, trisaccharides, tetrasaccharides, and oligosaccharides containing from about 4, 5, 6, 7, 8, or 9 monosaccharide units), and polysaccharides, such as starches, glycogen, cellulose and polysaccharide gums. In some embodiments, the carbohydrate incorporated into the ligand is a monosaccharide selected from a pentose, hexose, or heptose and di- and tri-saccharides including such monosaccharide units. In other embodiments, the carbohydrate incorporated into the ligand is an amino sugar, such as galactosamine, glucosamine, N-acetylgalactosamine, and N-acetylglucosamine.

In some embodiments, the ligand comprises a hexose or hexosamine. The hexose may be selected from glucose, galactose, mannose, fucose, or fructose. The hexosamine may be selected from fructosamine, galactosamine, glucosamine, or mannosamine. In certain embodiments, the ligand comprises glucose, galactose, galactosamine, or glucosamine. In one embodiment, the ligand comprises glucose, glucosamine, or N-acetylglucosamine. In another embodiment, the ligand comprises galactose, galactosamine, or N-acetyl-galactosamine. In particular embodiments, the ligand comprises N-acetyl-galactosamine. Ligands comprising glucose, galactose, and N-acetyl-galactosamine (GalNAc) are particularly effective in targeting compounds to liver cells because such ligands bind to the ASGR expressed on the surface of hepatocytes. See, e.g., D'Souza and Devarajan, J. Control Release, Vol. 203:126-139, 2015. Examples of GalNAc- or galactose-containing ligands that can be incorporated into the RNAi constructs of the invention are described in U.S. Pat. Nos. 7,491,805; 8,106,022; and 8,877,917; U.S. Patent Publication No. 20030130186; and WIPO Publication No. WO 2013166155, all of which are hereby incorporated by reference in their entireties.

In certain embodiments, the ligand comprises a multivalent carbohydrate moiety. As used herein, a "multivalent carbohydrate moiety" refers to a moiety comprising two or more carbohydrate units capable of independently binding or interacting with other molecules. For example, a multivalent carbohydrate moiety comprises two or more binding domains comprised of carbohydrates that can bind to two or more different molecules or two or more different sites on the same molecule. The valency of the carbohydrate moiety denotes the number of individual binding domains within the carbohydrate moiety. For instance, the terms "monovalent," "bivalent," "trivalent," and "tetravalent" with reference to the carbohydrate moiety refer to carbohydrate moieties with one, two, three, and four binding domains, respectively. The multivalent carbohydrate moiety may comprise a multivalent lactose moiety, a multivalent galactose moiety, a multivalent glucose moiety, a multivalent N-acetyl-galactosamine moiety, a multivalent N-acetyl-glucosamine moiety, a multivalent mannose moiety, or a multivalent fucose moiety. In some embodiments, the ligand comprises a multivalent galactose moiety. In other embodiments, the ligand comprises a multivalent N-acetyl-galactosamine moiety. In these and other embodiments, the multivalent carbohydrate moiety is bivalent, trivalent, or tetravalent. In such embodiments, the multivalent carbohydrate moiety can be bi-antennary or tri-antennary. In one particular embodiment, the multivalent N-acetyl-galactosamine moiety is trivalent or tetravalent. In another particular embodiment, the multivalent galactose moiety is trivalent or tetravalent. Exemplary trivalent and tetravalent GalNAc-containing ligands for incorporation into the RNAi constructs of the invention are described in detail below.

The ligand can be attached or conjugated to the RNA molecule of the RNAi construct directly or indirectly. For instance, in some embodiments, the ligand is covalently attached directly to the sense or antisense strand of the RNAi construct. In other embodiments, the ligand is covalently attached via a linker to the sense or antisense strand of the RNAi construct. The ligand can be attached to nucleobases, sugar moieties, or internucleotide linkages of polynucleotides (e.g. sense strand or antisense strand) of the RNAi constructs of the invention. Conjugation or attachment to purine nucleobases or derivatives thereof can occur at any position including, endocyclic and exocyclic atoms. In certain embodiments, the 2-, 6-, 7-, or 8-positions of a purine nucleobase are attached to a ligand. Conjugation or attachment to pyrimidine nucleobases or derivatives thereof can also occur at any position. In some embodiments, the 2-, 5-, and 6-positions of a pyrimidine nucleobase can be attached to a ligand. Conjugation or attachment to sugar moieties of nucleotides can occur at any carbon atom. Example carbon atoms of a sugar moiety that can be attached to a ligand include the 2', 3', and 5' carbon atoms. The 1' position can also be attached to a ligand, such as in an abasic residue. Internucleotide linkages can also support ligand attachments. For phosphorus-containing linkages (e.g., phosphodiester, phosphorothioate, phosphorodithiotate, phosphoroamidate, and the like), the ligand can be attached directly to the phosphorus atom or to an O, N, or S atom bound to the phosphorus atom. For amine- or amide-containing internucleoside linkages (e.g., PNA), the ligand can be attached to the nitrogen atom of the amine or amide or to an adjacent carbon atom.

In certain embodiments, the ligand may be attached to the 3' or 5' end of either the sense or antisense strand. In certain embodiments, the ligand is covalently attached to the 5' end of the sense strand. In other embodiments, the ligand is covalently attached to the 3' end of the sense strand. For example, in some embodiments, the ligand is attached to the 3'-terminal nucleotide of the sense strand. In certain such embodiments, the ligand is attached at the 3'-position of the 3'-terminal nucleotide of the sense strand. In alternative embodiments, the ligand is attached near the 3' end of the sense strand, but before one or more terminal nucleotides (i.e. before 1, 2, 3, or 4 terminal nucleotides). In some embodiments, the ligand is attached at the 2'-position of the sugar of the 3'-terminal nucleotide of the sense strand.

In certain embodiments, the ligand is attached to the sense or antisense strand via a linker. A "linker" is an atom or group of atoms that covalently joins a ligand to a polynucleotide component of the RNAi construct. The linker may be from about 1 to about 30 atoms in length, from about 2 to about 28 atoms in length, from about 3 to about 26 atoms in length, from about 4 to about 24 atoms in length, from about 6 to about 20 atoms in length, from about 7 to about 20 atoms in length, from about 8 to about 20 atoms in length, from about 8 to about 18 atoms in length, from about 10 to about 18 atoms in length, and from about 12 to about 18 atoms in length. In some embodiments, the linker may comprise a bifunctional linking moiety, which generally comprises an alkyl moiety with two functional groups. One of the functional groups is selected to bind to the compound of interest (e.g. sense or antisense strand of the RNAi construct) and the other is selected to bind essentially any selected group, such as a ligand as described herein. In certain embodiments, the linker comprises a chain structure or an oligomer of repeating units, such as ethylene glycol or amino acid units. Examples of functional groups that are typically employed in a bifunctional linking moiety include, but are not limited to, electrophiles for reacting with nucleophilic groups and nucleophiles for reacting with electrophilic groups. In some embodiments, bifunctional linking moieties include amino, hydroxyl, carboxylic acid, thiol, unsaturations (e.g., double or triple bonds), and the like.

Linkers that may be used to attach a ligand to the sense or antisense strand in the RNAi constructs of the invention include, but are not limited to, pyrrolidine, 8-amino-3,6-dioxaoctanoic acid, succinimidyl 4-(N-maleimidomethyl) cyclohexane-1-carboxylate, 6-aminohexanoic acid, substituted $C_1$-$C_{10}$ alkyl, substituted or unsubstituted $C_2$-$C_{10}$ alkenyl or substituted or unsubstituted $C_2$-$C_{10}$ alkynyl. Preferred substituent groups for such linkers include, but are not limited to, hydroxyl, amino, alkoxy, carboxy, benzyl, phenyl, nitro, thiol, thioalkoxy, halogen, alkyl, aryl, alkenyl and alkynyl.

In certain embodiments, the linkers are cleavable. A cleavable linker is one which is sufficiently stable outside the cell, but which upon entry into a target cell is cleaved to release the two parts the linker is holding together. In some embodiments, the cleavable linker is cleaved at least 10 times, 20 times, 30 times, 40 times, 50 times, 60 times, 70 times, 80 times, 90 times, or more, or at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linkers are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linker by reduction; esterases; endosomes or agents that can create an acidic environment, e.g., those that result in a pH of five or lower; enzymes that can hydrolyze or degrade an acid cleavable linker by acting as a general acid, peptidases (which can be substrate specific), and phosphatases.

A cleavable linker may comprise a moiety that is susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable group that is cleaved at a preferred pH, thereby releasing the RNA molecule from the ligand inside the cell, or into the desired compartment of the cell.

A linker can include a cleavable group that is cleavable by a particular enzyme. The type of cleavable group incorporated into a linker can depend on the cell to be targeted. For example, liver-targeting ligands can be linked to RNA molecules through a linker that includes an ester group. Liver cells are rich in esterases, and therefore the linker will be cleaved more efficiently in liver cells than in cell types that are not esterase-rich. Other types of cells rich in esterases include cells of the lung, renal cortex, and testis. Linkers that contain peptide bonds can be used when targeting cells rich in peptidases, such as liver cells and synoviocytes.

In general, the suitability of a candidate cleavable linker can be evaluated by testing the ability of a degradative agent (or condition) to cleave the candidate linker. It will also be desirable to also test the candidate cleavable linker for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate linkers are cleaved at least 2, 4, 10, 20, 50, 70, or 100 times faster in the cell (or under in vitro conditions selected to mimic intracellular conditions) as compared to blood or serum (or under in vitro conditions selected to mimic extracellular conditions).

In other embodiments, redox cleavable linkers are utilized. Redox cleavable linkers are cleaved upon reduction or oxidation. An example of reductively cleavable group is a disulfide linking group (—S—S—). To determine if a candidate cleavable linker is a suitable "reductively cleavable linker," or for example is suitable for use with a particular RNAi construct and particular ligand, one can use one or more methods described herein. For example, a candidate linker can be evaluated by incubation with dithiothreitol (DTT), or other reducing agent known in the art, which mimics the rate of cleavage that would be observed in a cell, e.g., a target cell. The candidate linkers can also be evaluated under conditions which are selected to mimic blood or serum conditions. In a specific embodiment, candidate linkers are cleaved by at most 10% in the blood. In other embodiments, useful candidate linkers are degraded at least 2, 4, 10, 20, 50, 70, or 100 times faster in the cell (or under in vitro conditions selected to mimic intracellular conditions) as compared to blood (or under in vitro conditions selected to mimic extracellular conditions).

In yet other embodiments, phosphate-based cleavable linkers are cleaved by agents that degrade or hydrolyze the phosphate group. An example of an agent that hydrolyzes phosphate groups in cells are enzymes, such as phosphatases in cells. Examples of phosphate-based cleavable groups are —O—P(O)(ORk)-O—, —O—P(S)(ORk)-O—, —O—P(S)(SRk)-O—, —S—P(O) (ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, and —O—P(S)(Rk)-S—, where Rk can be hydrogen or alkyl. Specific embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, and —O—P(S)(H)—S—. Another specific embodiment is —O—P(O)(OH)—O—. These candidate linkers can be evaluated using methods analogous to those described above.

In other embodiments, the linkers may comprise acid cleavable groups, which are groups that are cleaved under acidic conditions. In some embodiments, acid cleavable groups are cleaved in an acidic environment with a pH of about 6.5 or lower (e.g., about 6.0, 5.5, 5.0, or lower), or by agents, such as enzymes that can act as a general acid. In a cell, specific low pH organelles, such as endosomes and lysosomes, can provide a cleaving environment for acid cleavable groups. Examples of acid cleavable linking groups include, but are not limited to, hydrazones, esters, and esters of amino acids. Acid cleavable groups can have the general formula —C═NN—, C(O)O, or —OC(O). A specific embodiment is when the carbon attached to the oxygen of the ester (the alkoxy group) is an aryl group, substituted alkyl group, or tertiary alkyl group such as dimethyl, pentyl or t-butyl. These candidates can be evaluated using methods analogous to those described above.

In other embodiments, the linkers may comprise ester-based cleavable groups, which are cleaved by enzymes, such as esterases and amidases in cells. Examples of ester-based cleavable groups include, but are not limited to, esters of alkylene, alkenylene and alkynylene groups. Ester cleavable groups have the general formula —C(O)O—, or —OC(O)—. These candidate linkers can be evaluated using methods analogous to those described above.

In further embodiments, the linkers may comprise peptide-based cleavable groups, which are cleaved by enzymes, such as peptidases and proteases in cells. Peptide-based cleavable groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —$NHCHR^AC(O)NHCHR^BC(O)$—, where $R^A$ and $R^B$ are the side chains of the two adjacent amino acids. These candidates can be evaluated using methods analogous to those described above.

Exemplary linkers that can be employed for attaching ligands, particularly ligands comprising a GalNAc moiety, to the sense strand in the RNAi constructs of the invention, are shown in Formulas A-K below.

In one embodiment, the linker for attaching a ligand to the 3' end of the sense strand of an RNAi construct of the invention has the following structure of Formula A, wherein n is 1 or 2, R=ligand (e.g., moiety containing 3 to 4 GalNAc units) and R'=3' end of sense strand of a double stranded RNA molecule:

FORMULA A

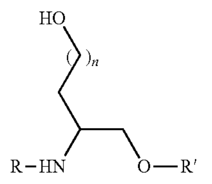

In another embodiment, the linker for attaching a ligand to the 3' end of the sense strand of an RNAi construct of the invention has the following structure of Formula B, wherein n is 1, 2, or 3, R=ligand (e.g., moiety containing 3 to 4 GalNAc units) and R'=3' end of sense strand of a double stranded RNA molecule:

FORMULA B

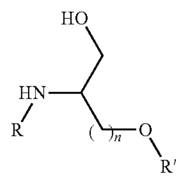

In yet another embodiment, the linker for attaching a ligand to the 3' end of the sense strand of an RNAi construct of the invention has the following structure of Formula C, wherein n is 1 or 2, R=ligand (e.g., moiety containing 3 to 4 GalNAc units), R'=3' end of sense strand of a double stranded RNA molecule, and R"═H, alkyl, functionalized alkyl:

FORMULA C

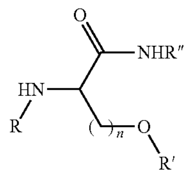

In certain embodiments, the linker for attaching a ligand to the 3' end of the sense strand of an RNAi construct of the invention has the following structure of Formula D, wherein R=ligand (e.g., moiety containing 3 to 4 GalNAc units) and R'=3' end of sense strand of a double stranded RNA molecule:

FORMULA D

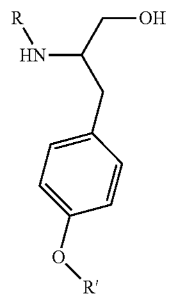

In certain other embodiments, the linker for attaching a ligand to the 3' end of the sense strand of an RNAi construct of the invention has the following structure of Formula E, wherein R=ligand (e.g., moiety containing 3 to 4 GalNAc units) and R'=3' end of sense strand of a double stranded RNA molecule:

FORMULA E

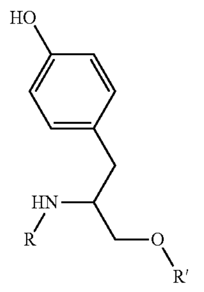

In some embodiments, the linker for attaching a ligand to the 3' end of the sense strand of an RNAi construct of the invention has the following structure of Formula F, wherein R=ligand (e.g., moiety containing 3 to 4 GalNAc units) and R'=3' end of sense strand of a double stranded RNA molecule:

FORMULA F

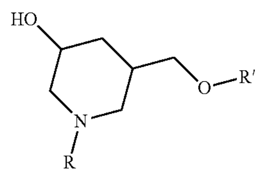

In other embodiments, the linker for attaching a ligand to the 3' end of the sense strand of an RNAi construct of the invention has the following structure of Formula G, wherein R=ligand (e.g., moiety containing 3 to 4 GalNAc units) and R'=3' end of sense strand of a double stranded RNA molecule:

FORMULA G

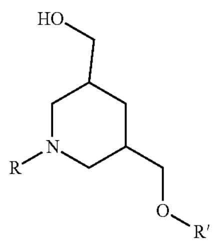

In certain other embodiments, the linker for attaching a ligand to the 3' end of the sense strand of an RNAi construct of the invention has the following structure of Formula H, wherein R=ligand (e.g., moiety containing 3 to 4 GalNAc units) and R'=3' end of sense strand of a double stranded RNA molecule:

FORMULA H

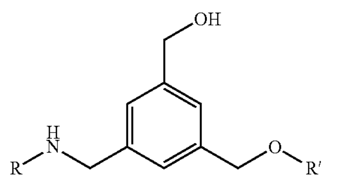

In some embodiments, the linker for attaching a ligand to the 3' end of the sense strand of an RNAi construct of the invention has the following structure of Formula J, wherein R=ligand (e.g., moiety containing 3 to 4 GalNAc units) and R'=3' end of sense strand of a double stranded RNA molecule:

FORMULA J

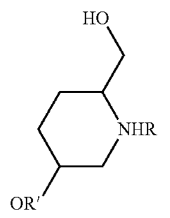

In other embodiments, the linker for attaching a ligand to the 3' end of the sense strand of an RNAi construct of the invention has the following structure of Formula K, wherein R=ligand (e.g., moiety containing 3 to 4 GalNAc units) and R'=3' end of sense strand of a double stranded RNA molecule:

FORMULA K

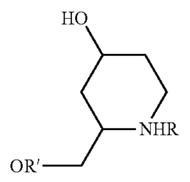

Other types of linkers suitable for attaching ligands to the sense or antisense strands in the RNAi constructs of the invention are known in the art and can include the linkers described in U.S. Pat. Nos. 7,723,509; 8,017,762; 8,828,956; 8,877,917; and 9,181,551, all of which are hereby incorporated by reference in their entireties.

In certain embodiments, the ligand covalently attached to the sense or antisense strand of the RNAi constructs of the invention comprises a GalNAc moiety, e.g, a multivalent GalNAc moiety. In some embodiments, the multivalent GalNAc moiety is a trivalent GalNAc moiety and is attached to the 3' end of the sense strand. In other embodiments, the multivalent GalNAc moiety is a trivalent GalNAc moiety and is attached to the 5' end of the sense strand. In yet other embodiments, the multivalent GalNAc moiety is a tetravalent GalNAc moiety and is attached to the 3' end of the sense strand. In still other embodiments, the multivalent GalNAc moiety is a tetravalent GalNAc moiety and is attached to the 5' end of the sense strand. Exemplary trivalent and tetravalent GalNAc moieties and linkers that can be attached to the double-stranded RNA molecules in the RNAi constructs of the invention are provided in the structural formulas I-XXIX below.

In one embodiment, the RNAi construct comprises a ligand and linker having the following structure of Formula I, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA I
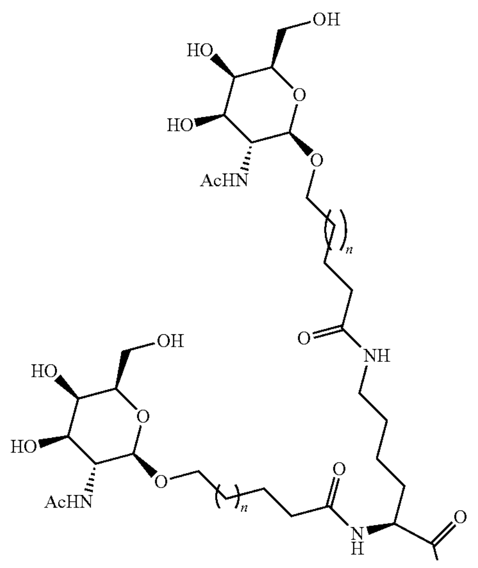
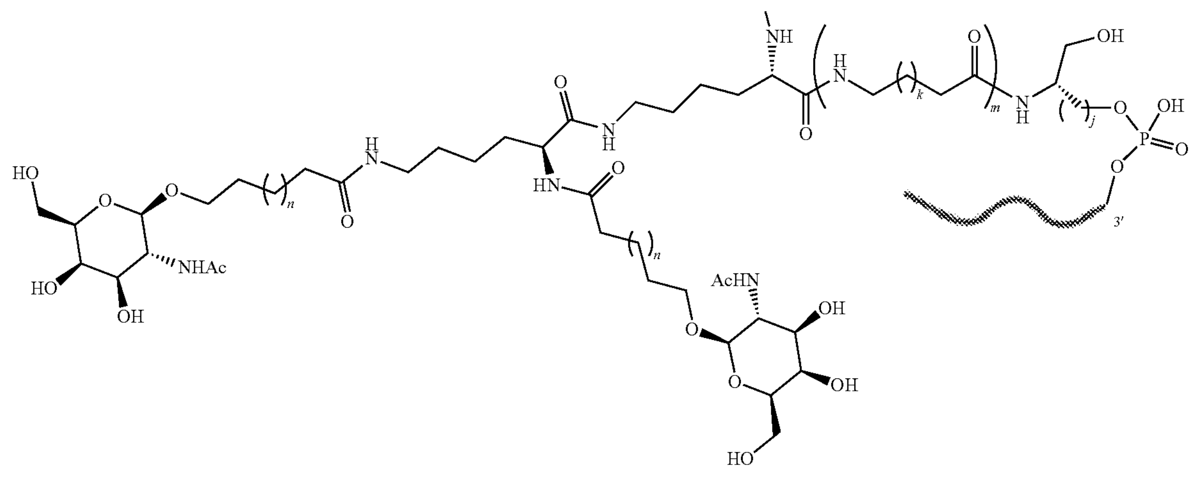
In another embodiment, the RNAi construct comprises a ligand and linker having the following structure of Formula II, wherein each n is independently 1 to 3, k is 1 to 3, m is 1 or 2, and the ligand is attached to the 3' end of the sense strand of the double-stranded RNA molecule (represented by the solid wavy line):

FORMULA II
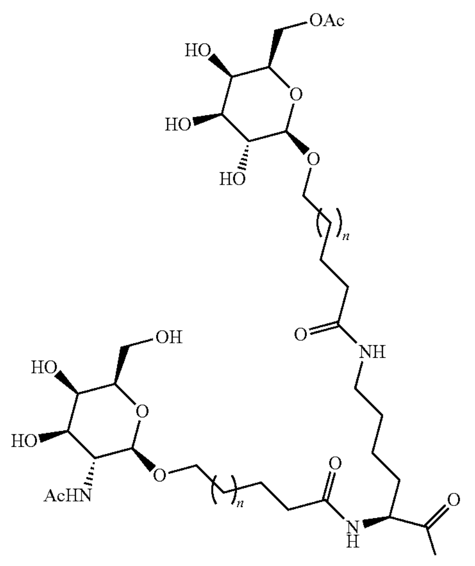
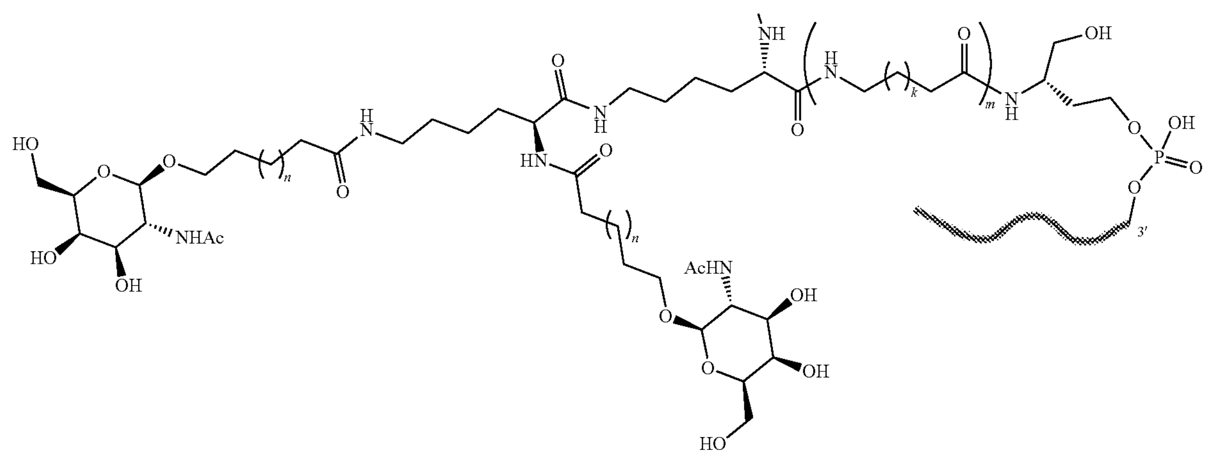
In yet another embodiment, the RNAi construct comprises a ligand and linker having the following structure of Formula III, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA III
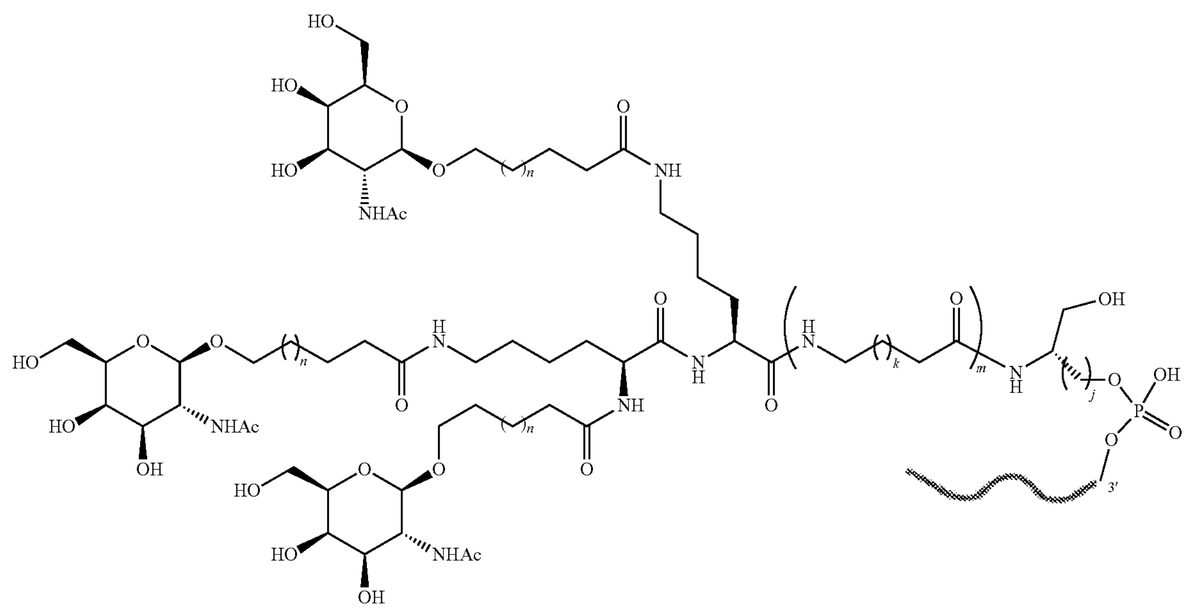
In still another embodiment, the RNAi construct comprises a ligand and linker having the following structure of Formula IV, wherein each n is independently 1 to 3, k is 1 to 3, m is 1 or 2, j is 1 or 2, and the ligand is attached to the 3' end of the sense strand of the double-stranded RNA molecule (represented by the solid wavy line):
FORMULA IV
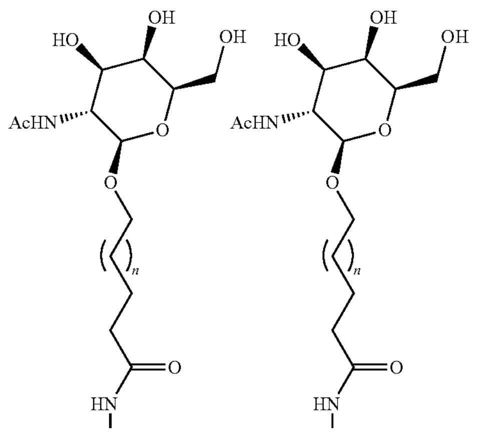

-continued
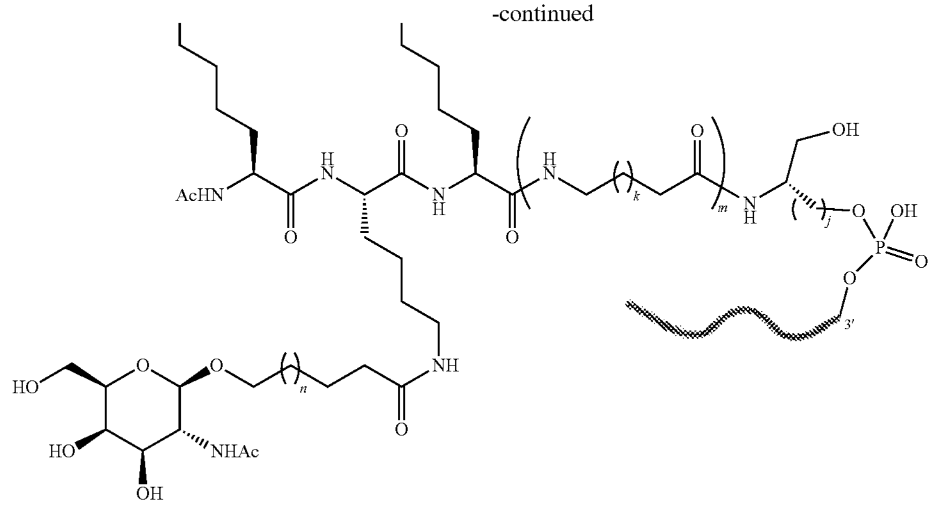
In still another embodiment, the RNAi construct comprises a ligand and linker having the following structure of Formula V, wherein each n is independently 1 to 3, k is 1 to 3, m is 1 or 2, j is 1 or 2, and the ligand is attached to the 3' end of the sense strand of the double-stranded RNA molecule (represented by the solid wavy line):
FORMULA V
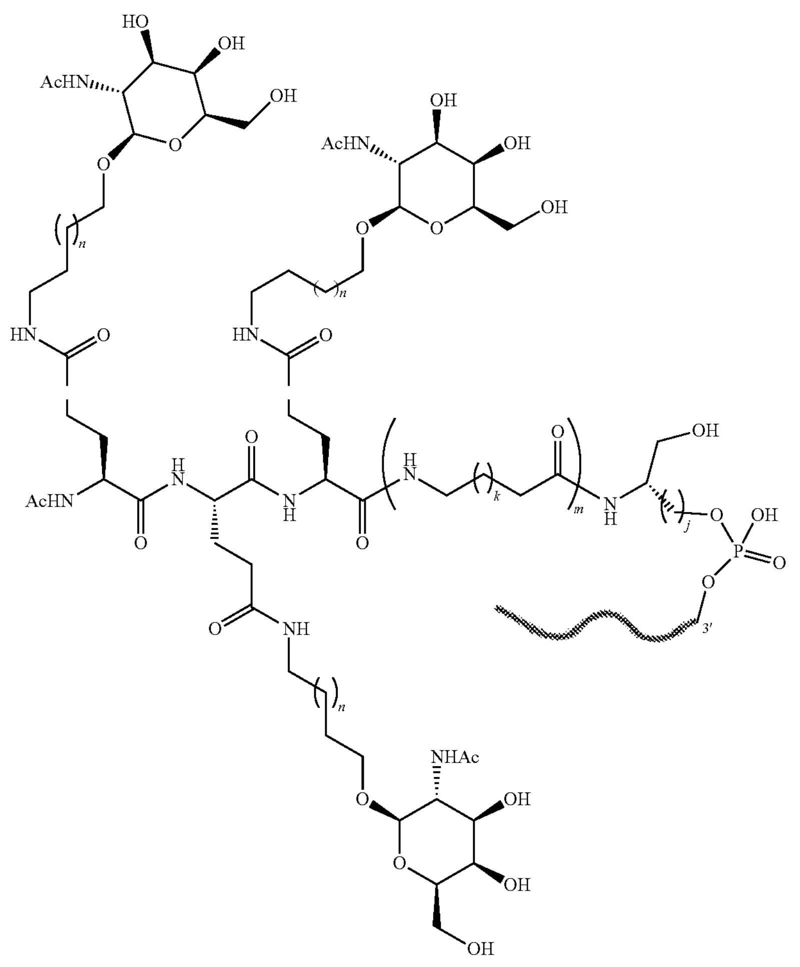

In another embodiment, the RNAi construct comprises a ligand and linker having the following structure of Formula VI, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA VI

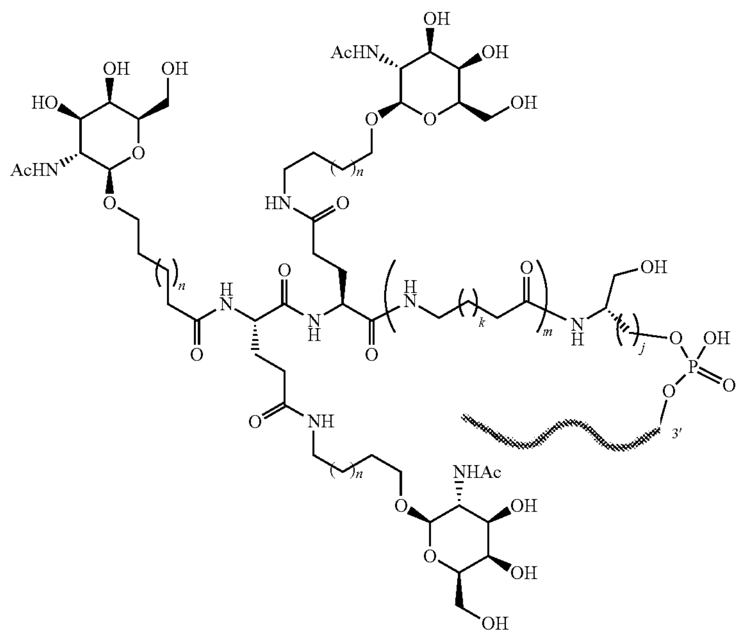

In one particular embodiment, the RNAi construct comprises a ligand and linker having the following structure of Formula VII, wherein the ligand is attached to the 3' end of the sense strand of the double-stranded RNA molecule (represented by the solid wavy line):

FORMULA VII

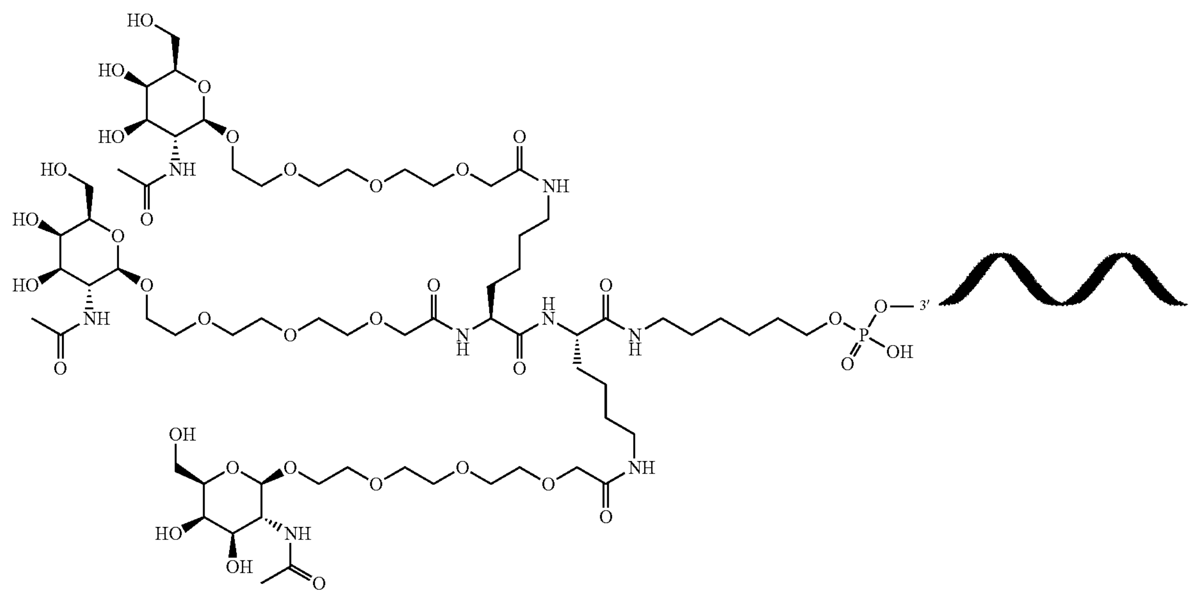

In another particular embodiment, the RNAi construct comprises a ligand and linker having the following structure of Formula VIII, wherein the ligand is attached to the 3' end of the sense strand of the double-stranded RNA molecule (represented by the solid wavy line):

FORMULA VIII

In certain embodiments, the RNAi construct comprises a ligand and linker having the following structure of Formula IX, wherein each n is independently 1 to 3, k is 1 to 3, m is 1 or 2, and the ligand is attached to the 3' end of the sense strand of the double-stranded RNA molecule (represented by the solid wavy line):

FORMULA IX

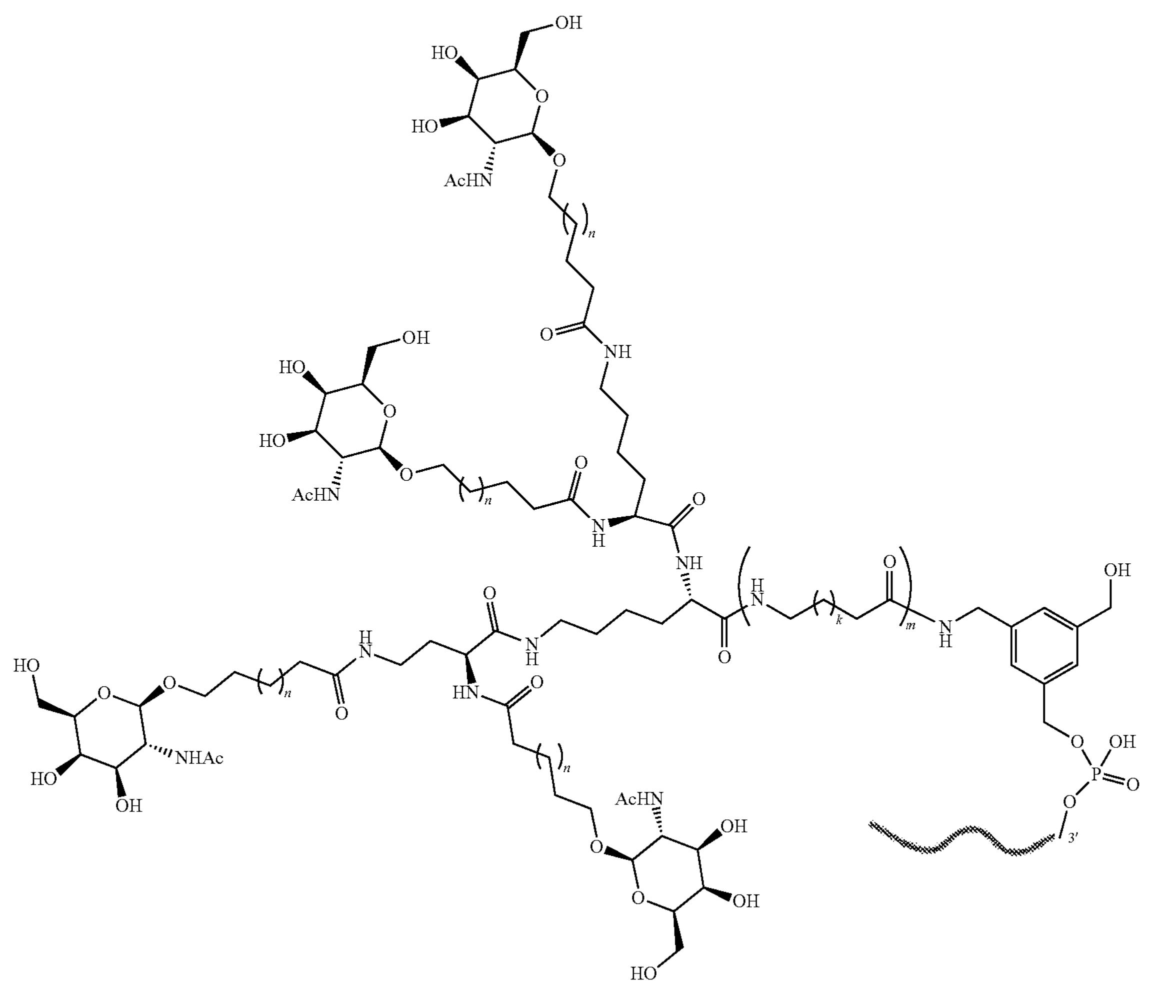

In other embodiments, the RNAi construct comprises a ligand and linker having the following structure of Formula X, wherein each n is independently 1 to 3, k is 1 to 3, m is 1 or 2, and the ligand is attached to the 3' end of the sense strand of the double-stranded RNA molecule (represented by the solid wavy line):

FORMULA X

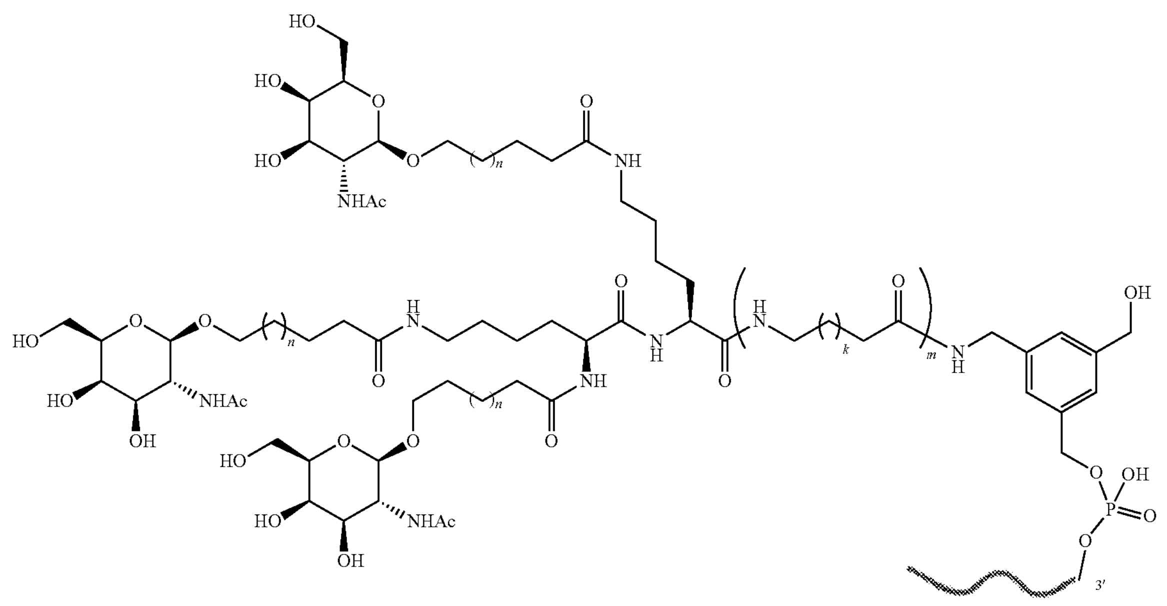

In one embodiment, the RNAi construct comprises a ligand and linker having the following structure of Formula XI, wherein each n is independently 1 to 3, k is 1 to 3, m is 1 or 2, and the ligand is attached to the 3' end of the sense strand of the double-stranded RNA molecule (represented by the solid wavy line):

FORMULA XI

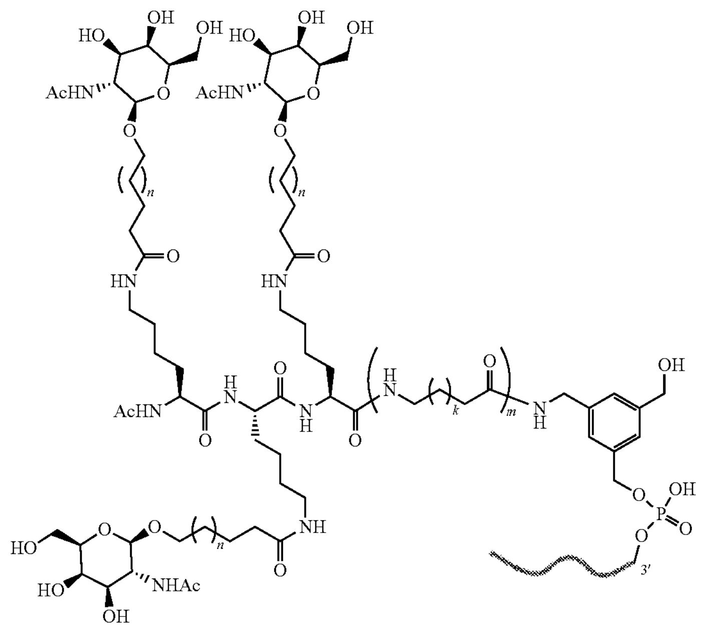

In another embodiment, the RNAi construct comprises a ligand and linker having the following structure of Formula XII, wherein each n is independently 1 to 3, k is 1 to 3, m is 1 or 2, and the ligand is attached to the 3' end of the sense strand of the double-stranded RNA molecule (represented by the solid wavy line):

FORMULA XII
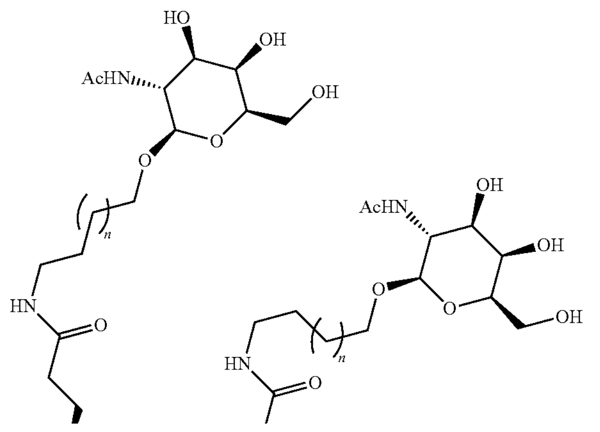
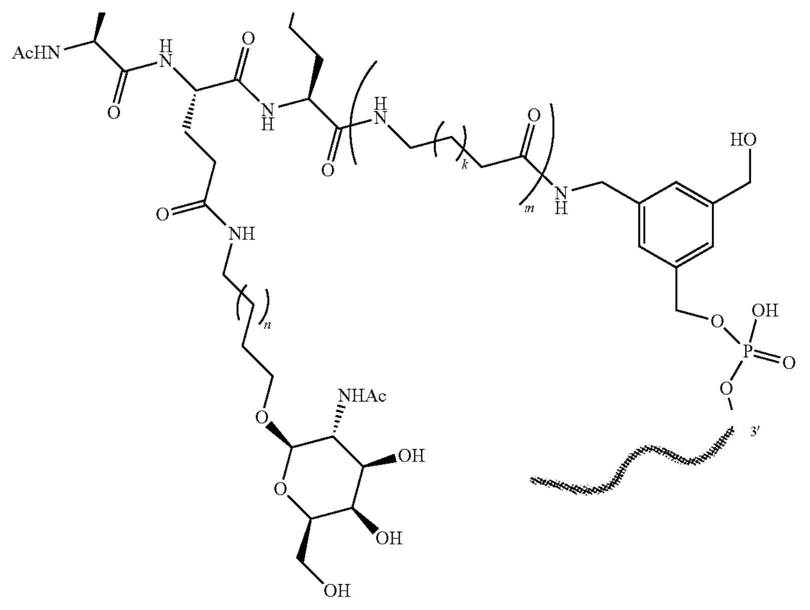
In yet another embodiment, the RNAi construct comprises a ligand and linker having the following structure of Formula XIII, wherein each n is independently 1 to 3, k is 1 to 3, m is 1 or 2, and the ligand is attached to the 3' end of the sense strand of the double-stranded RNA molecule (represented by the solid wavy line):

FORMULA XIII
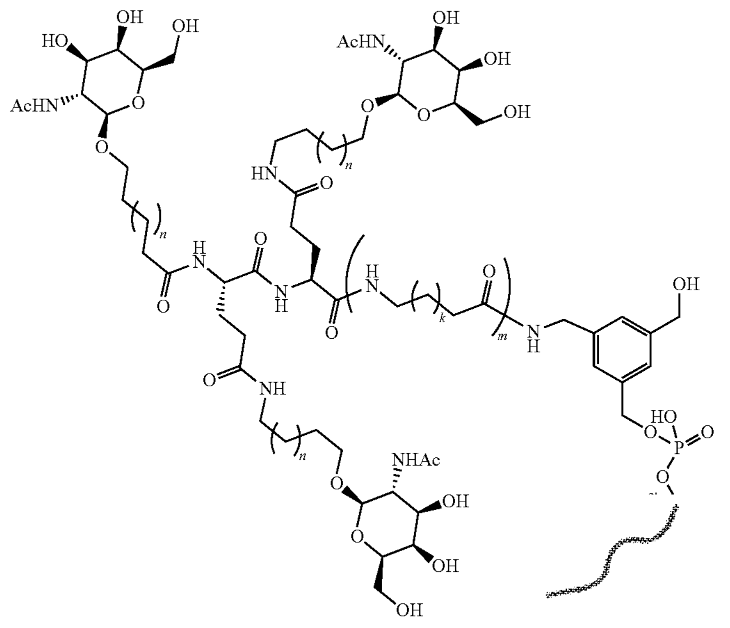
In certain embodiments, the RNAi construct comprises a ligand and linker having the following structure of Formula XIV, wherein each n is independently 1 to 3, k is 1 to 3, and the ligand is attached to the 5' end of the sense strand of the double-stranded RNA molecule (represented by the solid wavy line):
FORMULA XIV
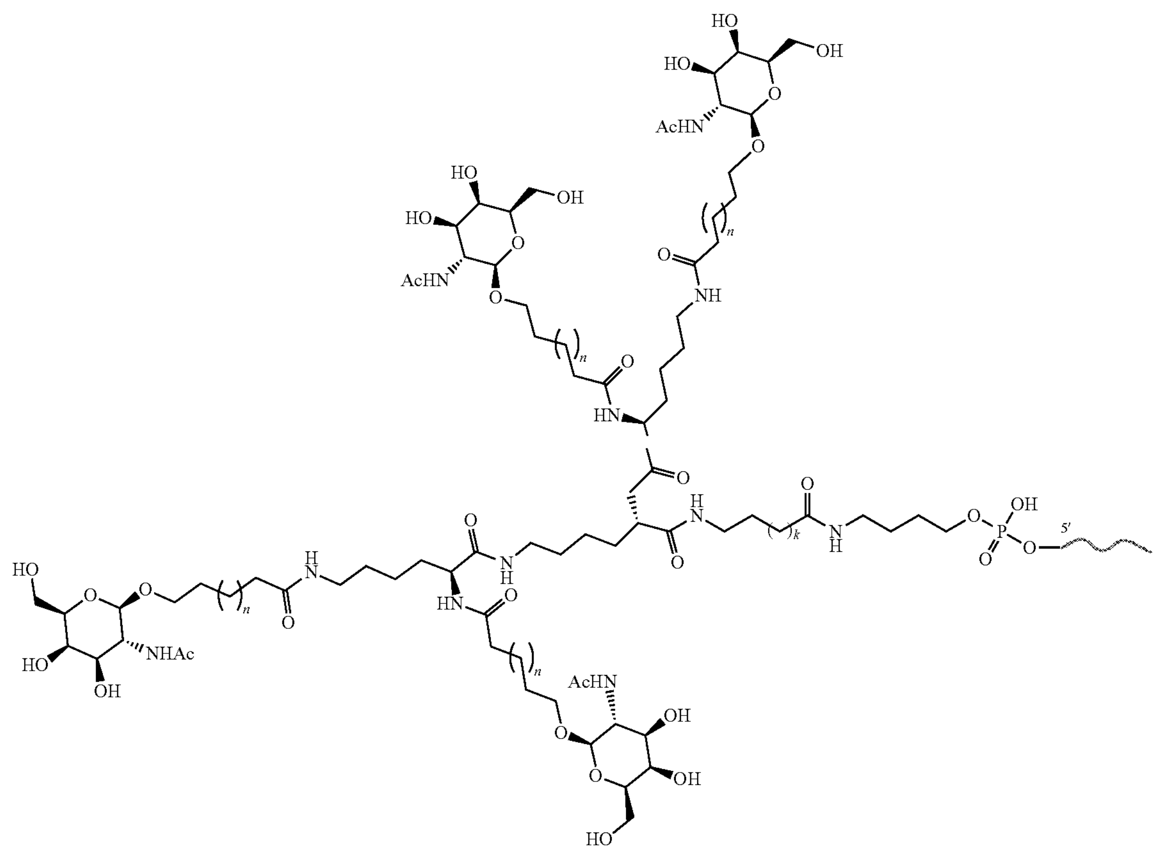

In one embodiment, the RNAi construct comprises a ligand and linker having the following structure of Formula XV, wherein each n is independently 1 to 3 and the ligand is attached to the 5' end of the sense strand of the double-stranded RNA molecule (represented by the solid wavy line):

FORMULA XV

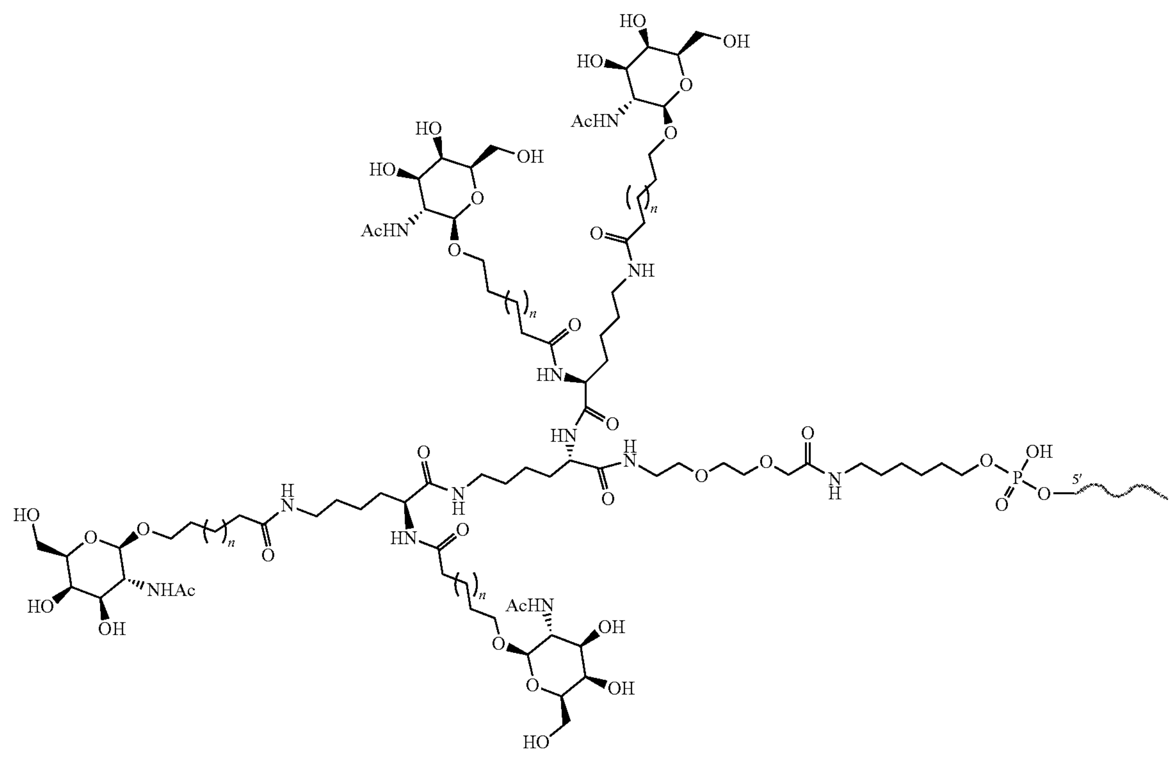

In other embodiments, the RNAi construct comprises a ligand and linker having the following structure of Formula XVI, wherein each n is independently 1 to 3, k is 1 to 3, and the ligand is attached to the 5' end of the sense strand of the double-stranded RNA molecule (represented by the solid wavy line):

FORMULA XVI

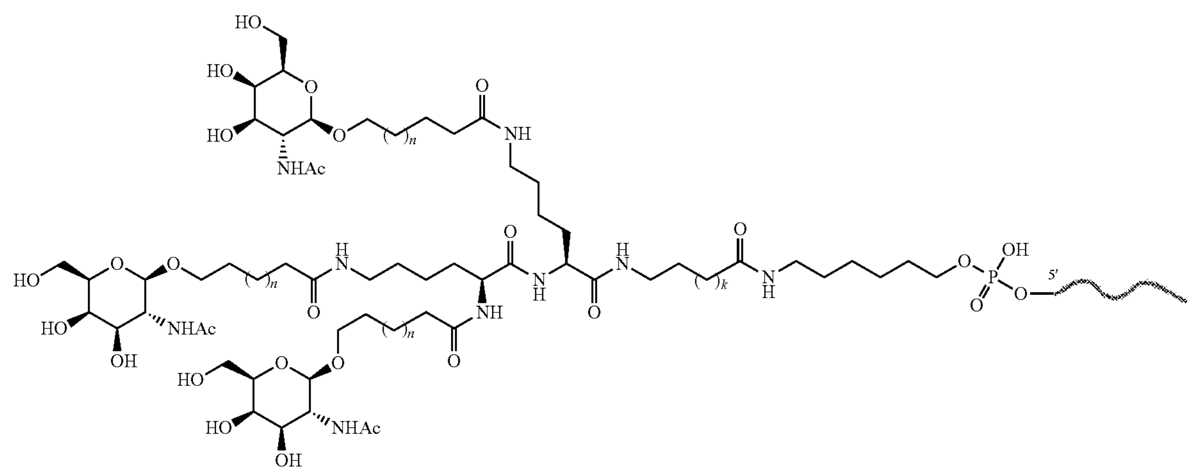

In one embodiment, the RNAi construct comprises a ligand and linker having the following structure of Formula XVII, wherein each n is independently 1 to 3 and the ligand is attached to the 5' end of the sense strand of the double-stranded RNA molecule (represented by the solid wavy line):

FORMULA XVII
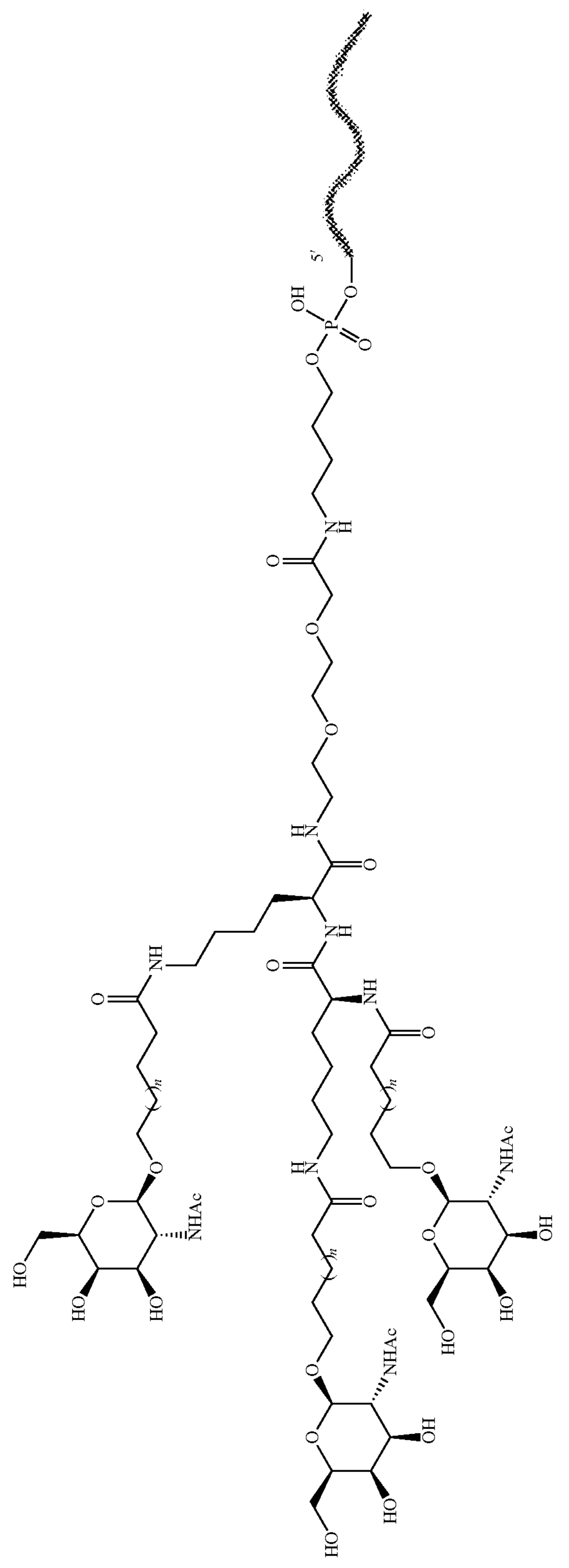

In certain other embodiments, the RNAi construct comprises a ligand and linker having the following structure of Formula XVIII, wherein each n is independently 1 to 3, k is 1 to 3, and the ligand is attached to the 5' end of the sense strand of the double-stranded RNA molecule (represented by the solid wavy line):

FORMULA XVIII

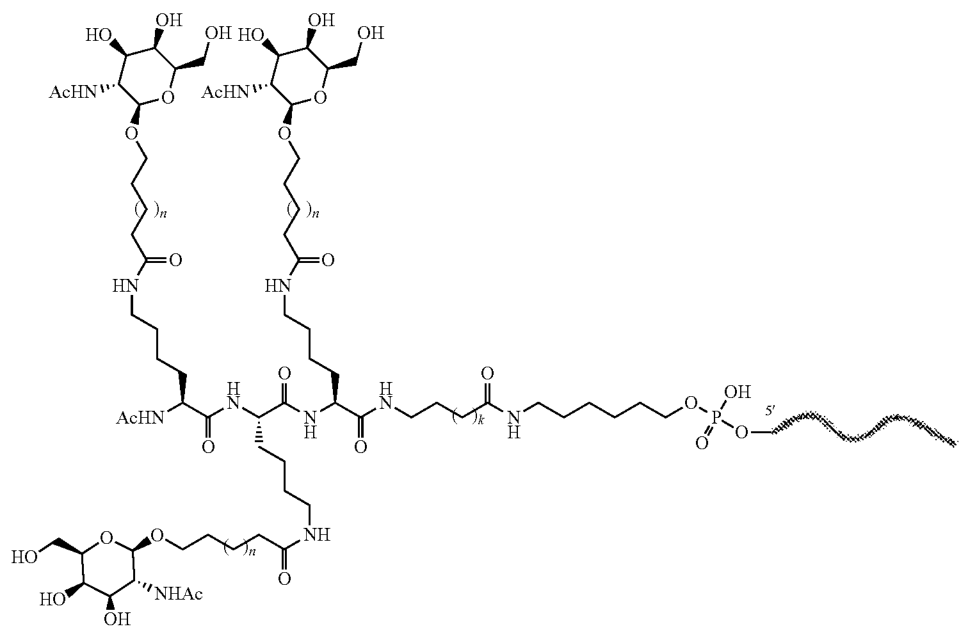

In one particular embodiment, the RNAi construct comprises a ligand and linker having the following structure of Formula XIX, wherein each n is independently 1 to 3 and the ligand is attached to the 5' end of the sense strand of the double-stranded RNA molecule (represented by the solid wavy line):

FORMULA XIX

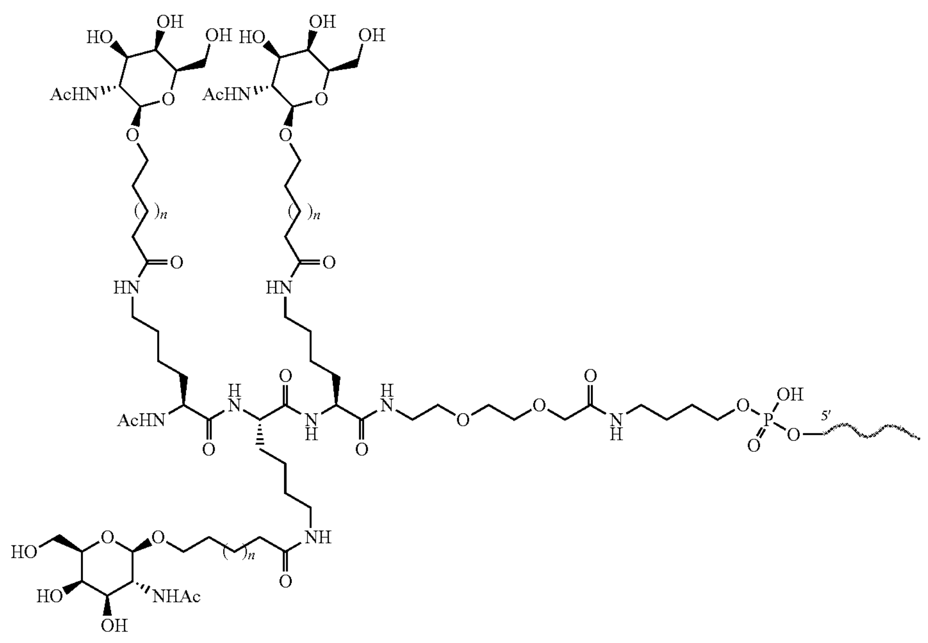

In some embodiments, the RNAi construct comprises a ligand and linker having the following structure of Formula XX, wherein each n is independently 1 to 3, k is 1 to 3, and the ligand is attached to the 5' end of the sense strand of the double-stranded RNA molecule (represented by the solid wavy line):

FORMULA XX

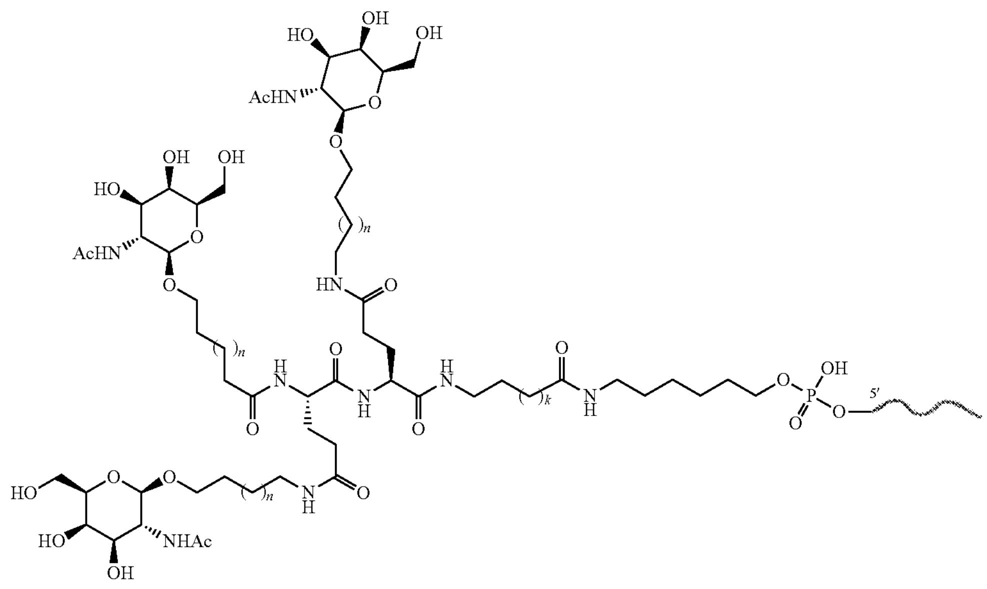

In one embodiment, the RNAi construct comprises a ligand and linker having the following structure of Formula XXI, wherein each n is independently 1 to 3, and the ligand is attached to the 5' end of the sense strand of the double-stranded RNA molecule (represented by the solid wavy line):

FORMULA XXI

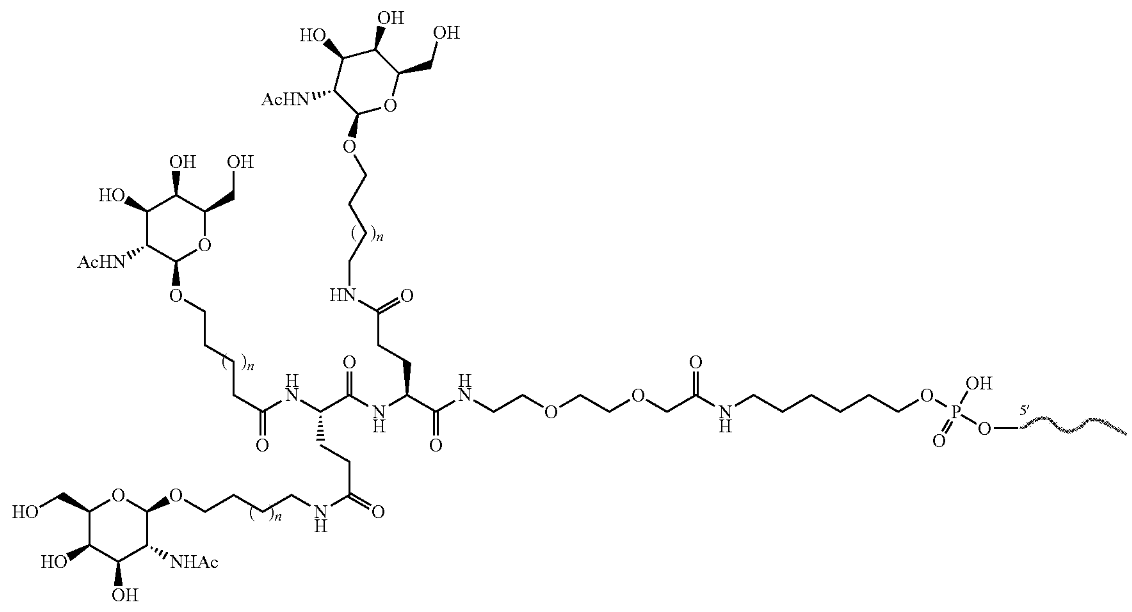

In certain embodiments, the RNAi construct comprises a ligand and linker having the following structure of Formula XXII, wherein each n is independently 1 to 3, k is 1 to 3, and the ligand is attached to the 5' end of the sense strand of the double-stranded RNA molecule (represented by the solid wavy line):

FORMULA XXII

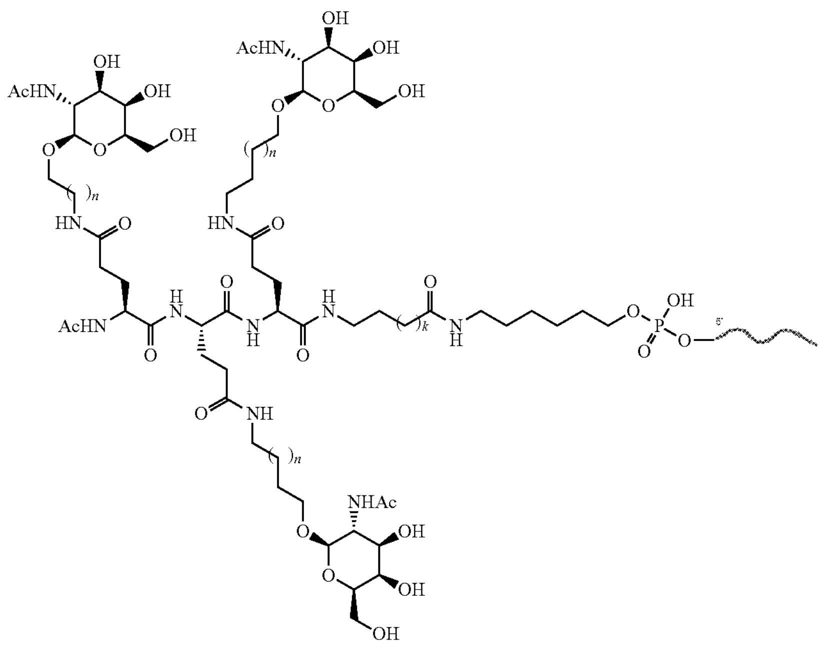

In one embodiment, the RNAi construct comprises a ligand and linker having the following structure of Formula XXIII, wherein each n is independently 1 to 3 and the ligand is attached to the 5' end of the sense strand of the double-stranded RNA molecule (represented by the solid wavy line):

FORMULA XXIII

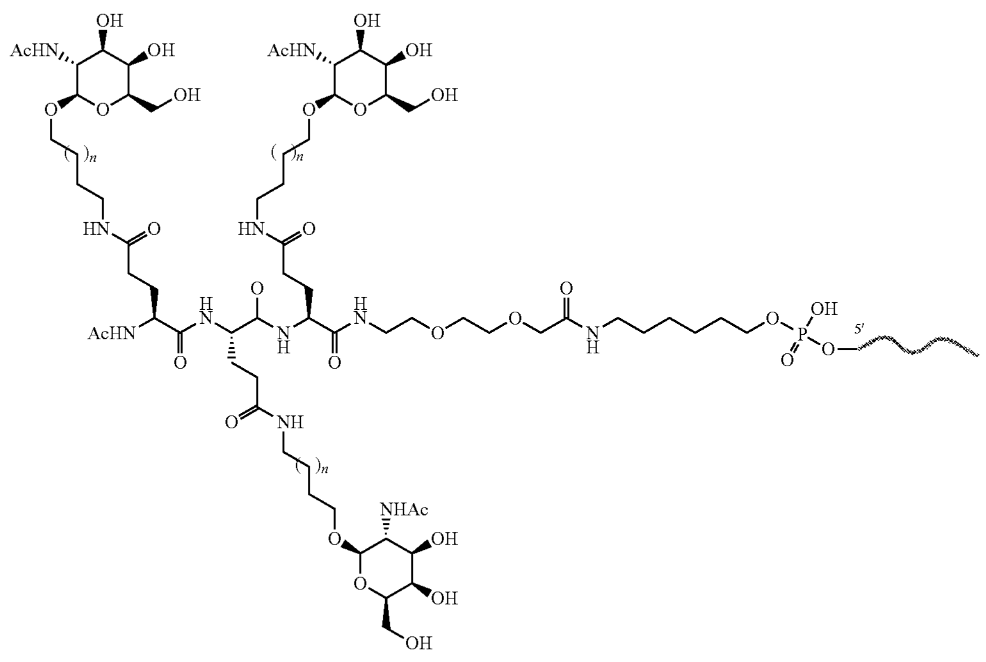

In certain other embodiments, the RNAi construct comprises a ligand and linker having the following structure of Formula XXIV, wherein each n is independently 1 to 3 and the ligand is attached to the 5' end of the sense strand of the double-stranded RNA molecule (represented by the solid wavy line):

FORMULA XXIV

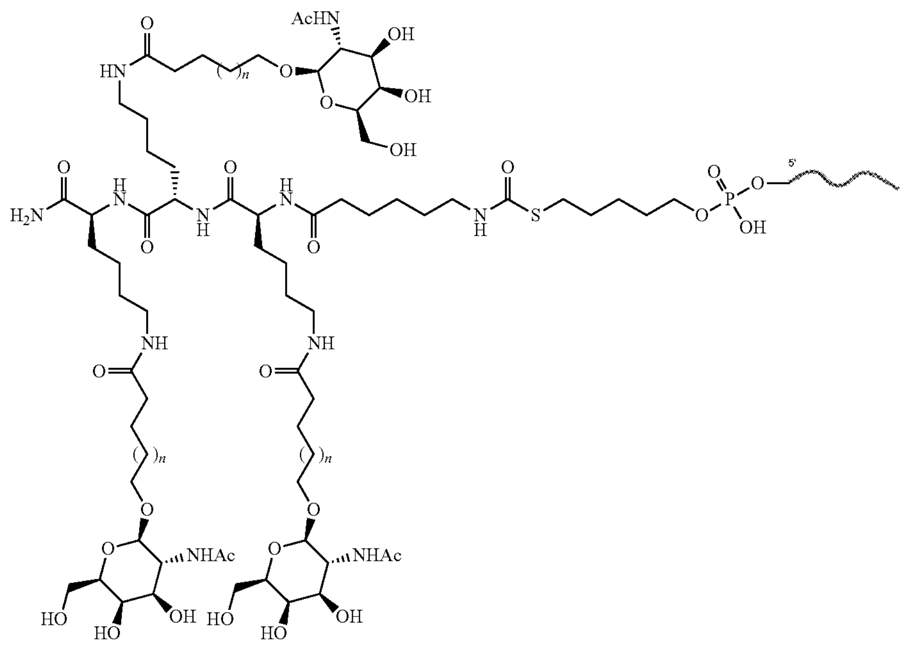

In another embodiment, the RNAi construct comprises a ligand and linker having the following structure of Formula XXV, wherein each n is independently 1 to 3 and the ligand is attached to the 5' end of the sense strand of the double-stranded RNA molecule (represented by the solid wavy line):

FORMULA XXV

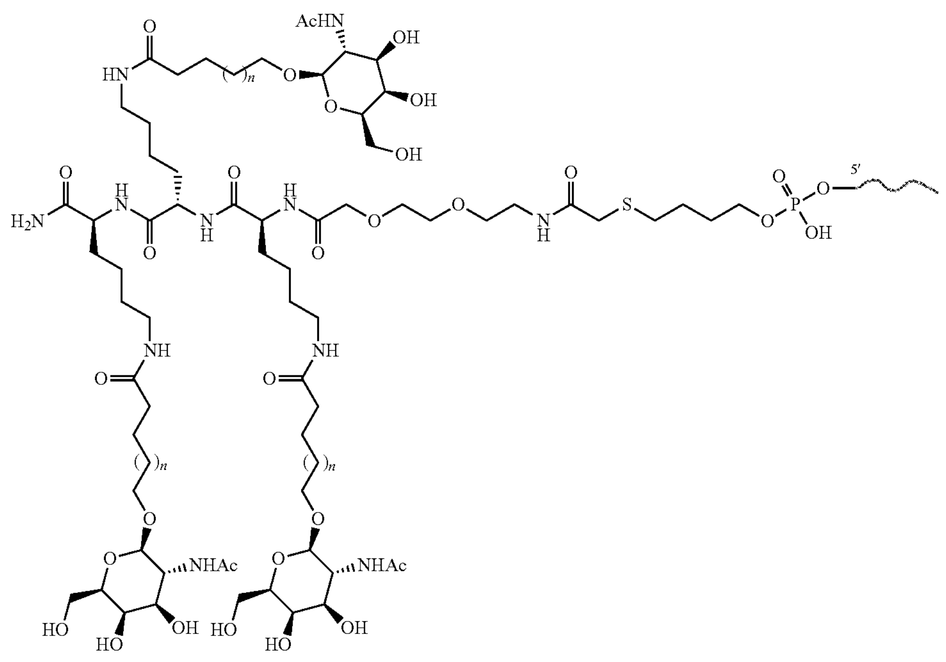

In certain embodiments, the RNAi construct comprises a ligand and linker having the following structure of Formula XXVI, wherein the ligand is attached to the 5' end of the sense strand of the double-stranded RNA molecule (represented by the solid wavy line):

FORMULA XXVI

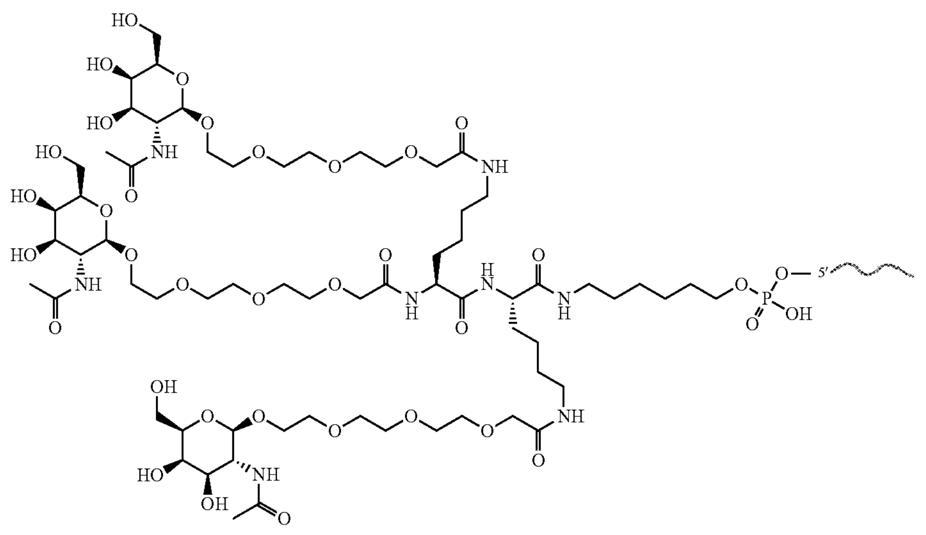

In one embodiment, the RNAi construct comprises a ligand and linker having the following structure of Formula XXVII, wherein each n is independently 1 to 3, k is 1 to 9, m is 1 or 2, and the ligand is attached to the 5' end of the sense strand of the double-stranded RNA molecule (represented by the solid wavy line):

FORMULA XXVII

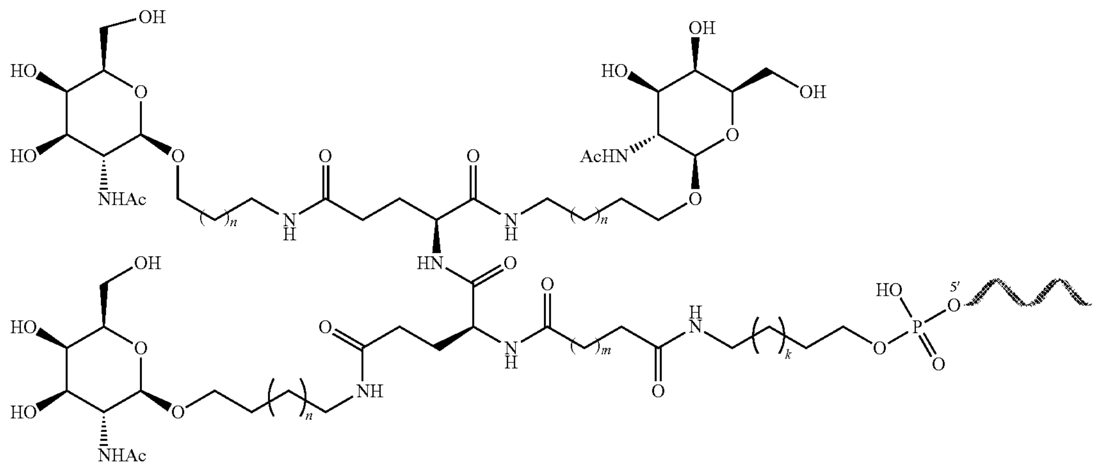

In another embodiment, the RNAi construct comprises a ligand and linker having the following structure of Formula XXVIII, wherein the ligand is attached to the 5' end of the sense strand of the double-stranded RNA molecule (represented by the solid wavy line):

FORMULA XXVII

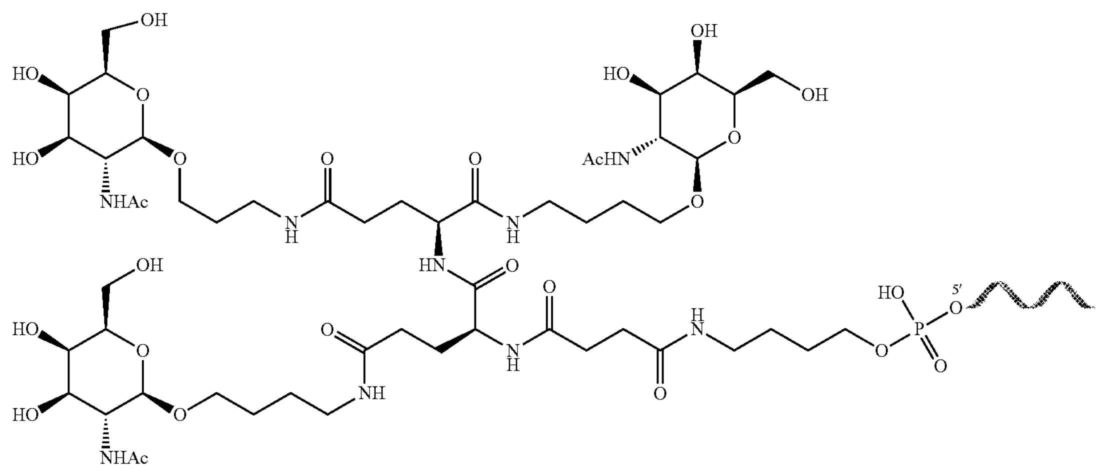

In one particular embodiment, the RNAi construct comprises a ligand and linker having the following structure of Formula XXIX, wherein the ligand is attached to the 3' end of the sense strand of the double-stranded RNA molecule (represented by the solid wavy line):

FORMULA XXIX

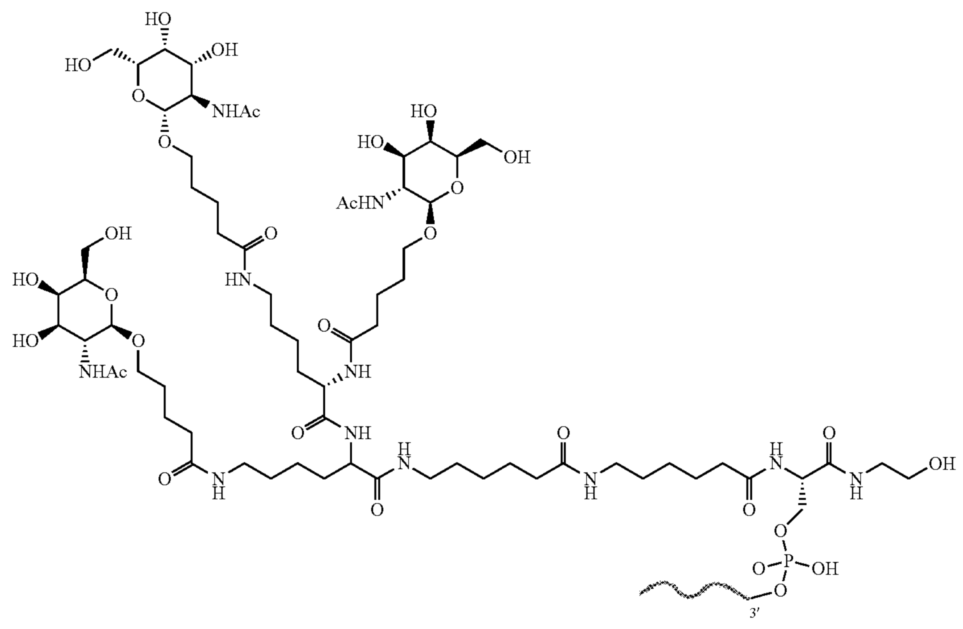

In some embodiments, the RNAi constructs of the invention may be delivered to a cell or tissue of interest by administering a vector that encodes and controls the intracellular expression of the RNAi construct. A "vector" (also referred to herein as an "expression vector) is a composition of matter which can be used to deliver a nucleic acid of interest to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. Examples of viral vectors include, but are not limited to, adenoviral vectors, adeno-associated viral vectors, retroviral vectors, and the like. A vector can be replicated in a living cell, or it can be made synthetically.

Generally, a vector for expressing an RNAi construct of the invention will comprise one or more promoters operably linked to sequences encoding the RNAi construct. The phrase "operably linked" or "under transcriptional control" as used herein means that the promoter is in the correct location and orientation in relation to a polynucleotide sequence to control the initiation of transcription by RNA polymerase and expression of the polynucleotide sequence. A "promoter" refers to a sequence recognized by the synthetic machinery of the cell, or introduced synthetic machinery, required to initiate the specific transcription of a gene sequence. Suitable promoters include, but are not limited to, RNA pol I, pol II, H1 or U6 RNA pol III, and viral promoters (e.g. human cytomegalovirus (CMV) immediate early gene promoter, the SV40 early promoter, and the Rous sarcoma virus long terminal repeat). In some embodiments, a H1 or U6 RNA pol III promoter is preferred. The promoter can be a tissue-specific or inducible promoter. Of particular interest are liver-specific promoters, such as promoter sequences from human alpha 1-antitrypsin gene, albumin gene, hemopexin gene, and hepatic lipase gene. Inducible promoters include promoters regulated by ecdysone, estrogen, progesterone, tetracycline, and isopropyl-P-D1-thiogalactopyranoside (IPTG).

In some embodiments in which the RNAi construct comprises a siRNA, the two separate strands (sense and antisense strand) can be expressed from a single vector or two separate vectors. For example, in one embodiment, the sequence encoding the sense strand is operably linked to a promoter on a first vector and the sequence encoding the antisense strand is operably linked to a promoter on a second vector. In such an embodiment, the first and second vectors are co-introduced, e.g., by infection or transfection, into a target cell, such that the sense and antisense strands, once transcribed, will hybridize intracellularly to form the siRNA molecule. In another embodiment, the sense and antisense strands are transcribed from two separate promoters located in a single vector. In some such embodiments, the sequence encoding the sense strand is operably linked to a first promoter and the sequence encoding the antisense strand is operably linked to a second promoter, wherein the first and second promoters are located in a single vector. In one embodiment, the vector comprises a first promoter operably linked to a sequence encoding the siRNA molecule, and a second promoter operably linked to the same sequence in the opposite direction, such that transcription of the sequence from the first promoter results in the synthesis of the sense strand of the siRNA molecule and transcription of the sequence from the second promoter results in synthesis of the antisense strand of the siRNA molecule.

In other embodiments in which the RNAi construct comprises a shRNA, a sequence encoding the single, at least partially self-complementary RNA molecule is operably linked to a promoter to produce a single transcript. In some embodiments, the sequence encoding the shRNA comprises an inverted repeat joined by a linker polynucleotide sequence to produce the the stem and loop structure of the shRNA following transcription.

In some embodiments, the vector encoding an RNAi construct of the invention is a viral vector. Various viral vector systems that are suitable to express the RNAi constructs described herein include, but are not limited to, adenoviral vectors, retroviral vectors (e.g., lentiviral vectors, moloney murine leukemia virus), adeno-associated viral vectors; herpes simplex viral vectors; SV40 vectors; polyoma viral vectors; papilloma viral vectors; picornaviral vectors; and pox viral vectors (e.g. vaccinia virus). In certain embodiments, the viral vector is a retroviral vector (e.g. lentiviral vector).

Various vectors suitable for use in the invention, methods for inserting nucleic acid sequences encoding siRNA or shRNA molecules into vectors, and methods of delivering the vectors to the cells of interest are within the skill of those in the art. See, e.g., Dornburg, Gene Therap., Vol. 2:301-310, 1995; Eglitis, Biotechniques, Vol. 6:608-614, 1988; Miller, Hum Gene Therap., Vol. 1:5-14, 1990; Anderson, Nature, Vol. 392:25-30, 1998; Rubinson D A et al., Nat. Genet., Vol. 33:401-406, 2003; Brummelkamp et al., Science, Vol. 296: 550-553, 2002; Brummelkamp et al., Cancer Cell, Vol. 2:243-247, 2002; Lee et al., Nat Biotechnol, Vol. 20:500-505, 2002; Miyagishi et al., Nat Biotechnol, Vol. 20:497-500, 2002; Paddison et al., Genes Dev, Vol. 16:948-958, 2002; Paul et al., Nat Biotechnol, Vol. 20:505-508, 2002; *Sui* et al., Proc Natl Acad Sci USA, Vol. 99:5515-5520, 2002; and Yu et al., Proc Natl Acad Sci USA, Vol. 99:6047-6052, 2002, all of which are hereby incorporated by reference in their entireties.

The present invention also includes pharmaceutical compositions and formulations comprising the RNAi constructs described herein and pharmaceutically acceptable carriers, excipients, or diluents. Such compositions and formulations are useful for reducing expression of ASGR1 in a subject in need thereof. Where clinical applications are contemplated, pharmaceutical compositions and formulations will be prepared in a form appropriate for the intended application. Generally, this will entail preparing compositions that are essentially free of pyrogens, as well as other impurities that could be harmful to humans or animals.

The phrases “pharmaceutically acceptable” or “pharmacologically acceptable” refer to molecular entities and compositions that do not produce adverse, allergic, or other untoward reactions when administered to an animal or a human. As used herein, “pharmaceutically acceptable carrier, excipient, or diluent” includes solvents, buffers, solutions, dispersion media, coatings, antibacterial and antifungal agents, isotonic and absorption delaying agents and the like acceptable for use in formulating pharmaceuticals, such as pharmaceuticals suitable for administration to humans. The use of such media and agents for pharmaceutically active substances is well known in the art. Except insofar as any conventional media or agent is incompatible with the RNAi constructs of the present invention, its use in therapeutic compositions is contemplated. Supplementary active ingredients also can be incorporated into the compositions, provided they do not inactivate the vectors or RNAi constructs of the compositions.

Compositions and methods for the formulation of pharmaceutical compositions depend on a number of criteria, including, but not limited to, route of administration, type and extent of disease or disorder to be treated, or dose to be administered. In some embodiments, the pharmaceutical compositions are formulated based on the intended route of delivery. For instance, in certain embodiments, the pharmaceutical compositions are formulated for parenteral delivery. Parenteral forms of delivery include intravenous, intraarterial, subcutaneous, intrathecal, intraperitoneal or intramuscular injection or infusion. In one embodiment, the pharmaceutical composition is formulated for intravenous delivery. In such an embodiment, the pharmaceutical composition may include a lipid-based delivery vehicle. In another embodiment, the pharmaceutical composition is formulated for subcutaneous delivery. In such an embodiment, the pharmaceutical composition may include a targeting ligand (e.g. GalNAc-containing or antibody-containing ligands described herein).

In some embodiments, the pharmaceutical compositions comprise an effective amount of an RNAi construct described herein. An “effective amount” is an amount sufficient to produce a beneficial or desired clinical result. In some embodiments, an effective amount is an amount sufficient to reduce ASGR1 expression in hepatocytes of a subject. In some embodiments, an effective amount may be an amount sufficient to only partially reduce ASGR1 expression, for example, to a level comparable to expression of the wild-type ASGR1 allele in human heterozygotes. Human heterozygous carriers of loss of function ASGR1 variant alleles were reported to have lower serum levels of non-HDL cholesterol and a lower risk of coronary artery disease and myocardial infarction as compared to non-carriers (Nioi et al., New England Journal of Medicine, Vol. 374 (22): 2131-2141, 2016). Thus, without being bound by theory, it is believed that partial reduction of ASGR1 expression may be sufficient to achieve the benefical reduction of serum non-HDL cholesterol and reduction of risk of coronary artery disease and myocardial infarction.

An effective amount of an RNAi construct of the invention may be from about 0.01 mg/kg body weight to about 100 mg/kg body weight, about 0.05 mg/kg body weight to about 75 mg/kg body weight, about 0.1 mg/kg body weight to about 50 mg/kg body weight, about 1 mg/kg to about 30 mg/kg body weight, about 2.5 mg/kg of body weight to about 20 mg/kg body weight, or about 5 mg/kg body weight to about 15 mg/kg body weight. In certain embodiments, a single effective dose of an RNAi construct of the invention may be about 0.1 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, or about 10 mg/kg. The pharmaceutical composition comprising an effective amount of RNAi construct can be administered weekly, biweekly, monthly, quarterly, or biannually. The precise determination of what would be considered an effective amount and frequency of administration may be based on several factors, including a patient's size, age, and general condition, type of disorder to be treated (e.g. myocardial infarction, heart failure, coronary artery disease, hypercholesterolemia), particular RNAi construct employed, and route of administration. Estimates of effective dosages and in vivo half-lives for any particular RNAi construct of the invention can be ascertained using conventional methods and/or testing in appropriate animal models.

Administration of the pharmaceutical compositions of the present invention may be via any common route so long as the target tissue is available via that route. Such routes include, but are not limited to, parenteral (e.g., subcutaneous, intramuscular, intraperitoneal or intravenous), oral, nasal, buccal, intradermal, transdermal, and sublingual routes, or by direct injection into liver tissue or delivery through the hepatic portal vein. In some embodiments, the pharmaceutical composition is administered parenterally. For instance, in certain embodiments, the pharmaceutical composition is administered intravenously. In other embodiments, the pharmaceutical composition is administered subcutaneously.

Colloidal dispersion systems, such as macromolecule complexes, nanocapsules, microspheres, beads, and lipid-based systems, including oil-in-water emulsions, micelles, mixed micelles, and liposomes, may be used as delivery vehicles for the RNAi constructs of the invention or vectors encoding such constructs. Commercially available fat emulsions that are suitable for delivering the nucleic acids of the invention include Intralipid® (Baxter International Inc.), Liposyn® (Abbott Pharmaceuticals), Liposyn®II (Hospira), Liposyn®III (Hospira), Nutrilipid (B. Braun Medical Inc.), and other similar lipid emulsions. A preferred colloidal system for use as a delivery vehicle in vivo is a liposome (i.e., an artificial membrane vesicle). The RNAi constructs of the invention may be encapsulated within liposomes or may form complexes thereto, in particular to cationic liposomes. Alternatively, RNAi constructs of the invention may be complexed to lipids, in particular to cationic lipids. Suitable lipids and liposomes include neutral (e.g., dioleoylphosphatidyl ethanolamine (DOPE), dimyristoylphosphatidyl choline (DMPC), and dipalmitoyl phosphatidylcholine (DPPC)), distearolyphosphatidyl choline), negative (e.g., dimyristoylphosphatidyl glycerol (DMPG)), and cationic (e.g., dioleoyltetramethylaminopropyl (DOTAP) and dioleoylphosphatidyl ethanolamine (DOTMA)). The preparation and use of such colloidal disperson systems is well known in the art. Exemplary formulations are also disclosed in U.S. Pat. Nos. 5,981,505; 6,217,900; 6,383,512; 5,783,565; 7,202,227; 6,379,965; 6,127,170; 5,837,533; 6,747,014; and WO03/093449.

In some embodiments, the RNAi constructs of the invention are fully encapsulated in a lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are exceptionally useful for systemic applications, as they exhibit extended circulation lifetimes following intravenous injection and accumulate at distal sites (e.g., sites physically separated from the administration site). SPLPs include "pSPLP," which include an encapsulated condensing agent-nucleic acid complex as set forth in PCT Publication No. WO 00/03683. The nucleic acid-lipid particles typically have a mean diameter of about 50 nm to about 150 nm, about 60 nm to about 130 nm, about 70 nm to about 110 nm, or about 70 nm to about 90 nm, and are substantially nontoxic. In addition, the nucleic acids when present in the nucleic acid-lipid particles are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

The pharmaceutical compositions suitable for injectable use include, for example, sterile aqueous solutions or dispersions and sterile powders for the extemporaneous preparation of sterile injectable solutions or dispersions. Generally, these preparations are sterile and fluid to the extent that easy injectability exists. Preparations should be stable under the conditions of manufacture and storage and should be preserved against the contaminating action of microorganisms, such as bacteria and fungi. Appropriate solvents or dispersion media may contain, for example, water, ethanol, polyol (for example, glycerol, propylene glycol, and liquid polyethylene glycol, and the like), suitable mixtures thereof, and vegetable oils. The proper fluidity can be maintained, for example, by the use of a coating, such as lecithin, by the maintenance of the required particle size in the case of dispersion and by the use of surfactants. The prevention of the action of microorganisms can be brought about by various antibacterial an antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

Sterile injectable solutions may be prepared by incorporating the active compounds in an appropriate amount into a solvent along with any other ingredients (for example as enumerated above) as desired, followed by filtered sterilization. Generally, dispersions are prepared by incorporating the various sterilized active ingredients into a sterile vehicle which contains the basic dispersion medium and the desired other ingredients, e.g., as enumerated above. In the case of sterile powders for the preparation of sterile injectable solutions, the preferred methods of preparation include vacuum-drying and freeze-drying techniques which yield a powder of the active ingredient(s) plus any additional desired ingredient from a previously sterile-filtered solution thereof.

The compositions of the present invention generally may be formulated in a neutral or salt form. Pharmaceutically-acceptable salts include, for example, acid addition salts (formed with free amino groups) derived from inorganic acids (e.g., hydrochloric or phosphoric acids), or from organic acids (e.g., acetic, oxalic, tartaric, mandelic, and the like). Salts formed with the free carboxyl groups can also be derived from inorganic bases (e.g., sodium, potassium, ammonium, calcium, or ferric hydroxides) or from organic bases (e.g., isopropylamine, trimethylamine, histidine, procaine and the like).

For parenteral administration in an aqueous solution, for example, the solution generally is suitably buffered and the liquid diluent first rendered isotonic for example with sufficient saline or glucose. Such aqueous solutions may be used, for example, for intravenous, intramuscular, subcutaneous and intraperitoneal administration. Preferably, sterile aqueous media are employed as is known to those of skill in the art, particularly in light of the present disclosure. By way of illustration, a single dose may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). For human administration, preparations should meet sterility, pyrogenicity, general safety and purity standards as required by FDA standards. In certain embodiments, a pharmaceutical composition of the invention comprises or consists of a sterile saline solution and an RNAi construct described herein. In other embodiments, a pharmaceutical composition of the invention comprises or consists of an RNAi construct described herein and sterile water (e.g. water for injection, WFI). In still other embodiments, a pharmaceutical composition of the invention comprises or consists of an RNAi construct described herein and phosphate-buffered saline (PBS).

In some embodiments, the pharmaceutical compositions of the invention are packaged with or stored within a device for administration. Devices for injectable formulations include, but are not limited to, injection ports, pre-filled syringes, autoinjectors, injection pumps, on-body injectors, and injection pens. Devices for aerosolized or powder formulations include, but are not limited to, inhalers, insufflators, aspirators, and the like. Thus, the present invention includes administration devices comprising a pharmaceutical composition of the invention for treating or preventing one or more of the disorders described herein.

The present invention provides methods for reducing or inhibiting expression of ASGR1 in a subject in need thereof as well as methods of treating or preventing conditions, diseases, or disorders associated with ASGR1 expression or activity. A "condition, disease, or disorder associated with ASGR1 expression" refers to conditions, diseases, or disorders in which ASGR1 expression levels are altered or where elevated expression levels of ASGR1 are associated with an increased risk of developing the condition, disease or disorder. A condition, disease, or disorder associated with ASGR1 expression can also include conditions, diseases, or disorders resulting from aberrant changes in lipoprotein metabolism, such as changes resulting in abnormal levels of cholesterol, lipids, triglycerides, etc. or impaired clearance of these molecules. Recently, human carriers of loss of function variant alleles of the ASGR1 subunit of the asialoglycoprotein receptor were reported to have lower serum levels of non-HDL cholesterol and a lower risk of coronary artery disease and myocardial infarction as compared to non-carriers (Nioi et al., New England Journal of Medicine, Vol. 374 (22): 2131-2141, 2016, which is hereby incorporated by reference in its entirety). Thus, in certain embodiments, the RNAi constructs of the invention are particularly useful for treating or preventing cardiovascular disease (e.g. coronary artery disease and myocardial infarction) and cholesterol-related disorders (e.g. hypercholesterolemia).

Conditions, diseases, and disorders associated with ASGR1 expression that can be treated or prevented according to the methods of the invention include, but are not limited to, cardiovascular disease, such as myocardial infarction, heart failure, stroke (ischemic and hemorrhagic), atherosclerosis, coronary artery disease, peripheral vascular disease (e.g. peripheral artery disease), vulnerable plaque, hypercholesterolemia, and dyslipidemia (manifesting, e.g., as elevated total cholesterol, elevated low-density lipoprotein (LDL), elevated very low-density lipoprotein (VLDL), elevated triglycerides, and/or low levels of high-density lipoprotein (HDL)).

In certain embodiments, the present invention provides a method for reducing the expression of ASGR1 in a patient in need thereof comprising administering to the patient any of the RNAi constructs described herein. The term "patient," as used herein, refers to a mammal, including humans, and can be used interchangeably with the term "subject." Preferably, the expression level of ASGR1 in hepatocytes in the patient is reduced following administration of the RNAi construct as compared to the ASGR1 expression level in a patient not receiving the RNAi construct.

In some embodiments, a patient in need of reduction of ASGR1 expression is a patient who is at risk of having a myocardial infarction. A patient who is at risk of having a myocardial infarction may be a patient who has a history of myocardial infarction (e.g. has had a previous myocardial infarction). A patient at risk of having a myocardial infarction may also be a patient who has a familial history of myocardial infarction or who has one or more risk factors of myocardial infarction. Such risk factors include, but are not limited to, hypertension, elevated levels of non-HDL cholesterol, elevated levels of triglycerides, diabetes, obesity, or history of autoimmune diseases (e.g. rheumatoid arthritis, lupus). In one embodiment, a patient who is at risk of having a myocardial infarction is a patient who has or is diagnosed with coronary artery disease. The risk of myocardial infarction in these and other patients can be reduced by administering to the patients any of the RNAi constructs described herein. Accordingly, the present invention provides a method for reducing the risk of myocardial infarction in a patient in need thereof comprising administering to the patient an RNAi construct described herein. In some embodiments, the present invention includes use of any of the RNAi constructs described herein in the preparation of a medicament for reducing the risk of myocardial infarction in a patient in need thereof. In other embodiments, the present invention provides an ASGR1-targeting RNAi construct for use in a method for reducing the risk of myocardial infarction in a patient in need thereof.

In certain embodiments, a patient in need of reduction of ASGR1 expression is a patient who is diagnosed with or at risk of cardiovascular disease. Thus, the present invention includes a method for treating or preventing cardiovascular disease in a patient in need thereof by administering any of the RNAi constructs of the invention. In some embodiments, the present invention includes use of any of the RNAi constructs described herein in the preparation of a medicament for treating or preventing cardiovascular disease in a patient in need thereof. In other embodiments, the present invention provides an ASGR1-targeting RNAi construct for use in a method for treating or preventing cardiovascular disease in a patient in need thereof. Cardiovascular disease includes myocardial infarction, heart failure, stroke (ischemic and hemorrhagic), atherosclerosis, coronary artery disease, peripheral vascular disease (e.g. peripheral artery disease), and vulnerable plaque. In some embodiments, the cardiovascular disease to be treated or prevented according to the methods of the invention is coronary artery disease. In other embodiments, the cardiovascular disease to be treated or prevented according to the methods of the invention is myocardial infarction. In certain embodiments, administration of the RNAi constructs described herein reduces the risk of non-fatal myocardial infarctions, fatal and non-fatal strokes, certain types of heart surgery (e.g. angioplasty, bypass), hospitalization for heart failure, chest pain in patients with heart disease, and/or cardiovascular events in patients with established heart disease (e.g. prior myocardial infarction, prior heart surgery, and/or chest pain with evidence of blocked arteries). In some embodiments, administration of the RNAi constructs described herein according to the methods of the invention can be used to reduce the risk of recurrent cardiovascular events.

In certain other embodiments, a patient in need of reduction of ASGR1 expression is a patient who has elevated levels of non-HDL cholesterol. Accordingly, in some embodiments, the present invention provides a method for reducing non-HDL cholesterol in a patient in need thereof by administering to the patient any of the RNAi constructs described herein. In some embodiments, the present invention includes use of any of the RNAi constructs described herein in the preparation of a medicament for reducing non-HDL cholesterol in a patient in need thereof. In other embodiments, the present invention provides an ASGR1-targeting RNAi construct for use in a method for reducing non-HDL cholesterol in a patient in need thereof. Non-HDL cholesterol is a measure of all cholesterol-containing proatherogenic lipoproteins, including LDL cholesterol, very low-density lipoprotein, intermediate-density lipoprotein, lipoprotein (a), chylomicron, and chylomicron remnants. Non-HDL cholesterol has been reported to be a good predictor of cardiovascular risk (Rana et al., Curr. Atheroscler. Rep., Vol. 14:130-134, 2012). Non-HDL cholesterol levels can be calculated by subtracting HDL cholesterol levels from total cholesterol levels. In one embodiment, a patient's LDL cholesterol levels are reduced following administration of the RNAi construct. In another embodiment, a patient's lipoprotein (a) levels are reduced following administration of the RNAi construct.

In some embodiments, a patient to be treated according to the methods of the invention is a patient who has elevated levels of non-HDL cholesterol (e.g. elevated serum levels of non-HDL cholesterol). Ideally, levels of non-HDL cholesterol should be about 30 mg/dL above the target for LDL cholesterol levels for any given patient. In particular embodiments, a patient is administered an RNAi construct of the invention if the patient has a non-HDL cholesterol level of about 130 mg/dL or greater. In one embodiment, a patient is administered an RNAi construct of the invention if the patient has a non-HDL cholesterol level of about 160 mg/dL or greater. In another embodiment, a patient is administered an RNAi construct of the invention if the patient has a non-HDL cholesterol level of about 190 mg/dL or greater. In still another embodiment, a patient is administered an RNAi construct of the invention if the patient has a non-HDL cholesterol level of about 220 mg/dL or greater. In certain embodiments, a patient is administered an RNAi construct of the invention if the patient is at a high or very high risk of cardiovascular disease according to the 2013 ACC/AHA Guideline on the Assessment of Cardiovascular Risk (Goff et al., ACC/AHA guideline on the assessment of cardiovascular risk: a report of the American College of Cardiology/American Heart Association Task Force on Practice Guidelines. *Circulation.* 2013; 00:000-000) and has a non-HDL cholesterol level of about 100 mg/dL or greater.

In some embodiments of the methods of the invention, a patient is administered an RNAi construct described herein if they are at a moderate risk or higher for cardiovascular disease according to the 2013 ACC/AHA Guideline on the Assessment of Cardiovascular Risk (referred to herein as the "2013 Guidelines"). In certain embodiments, an RNAi construct of the invention is administered to a patient if the patient's LDL cholesterol level is greater than about 160 mg/dL. In other embodiments, an RNAi construct of the invention is administered to a patient if the patient's LDL cholesterol level is greater than about 130 mg/dL and the patient has a moderate risk of cardiovascular disease according to the 2013 Guidelines. In still other embodiments, an RNAi construct of the invention is administered to a patient if the patient's LDL cholesterol level is greater than 100 mg/dL and the patient has a high or very high risk of cardiovascular disease according to the 2013 Guidelines.

In certain embodiments, a patient to be treated according to the methods of the invention is a patient who has a vulnerable plaque (also referred to as unstable plaque). Vulnerable plaques are a build-up of macrophages and lipids containing predominantly cholesterol that lie underneath the endothelial lining of the arterial wall. These vulnerable plaques can rupture resulting in the formation of a blood clot, which can potentially block blood flow through the artery and cause a myocardial infarction or stroke. Vulnerable plaques can be identified by methods known in the art, including, but not limited to, intravascular ultrasound and computed tomography (Sahara et al., European Heart Journal, Vol. 25:2026-2033, 2004; Budhoff, J. Am. Coll. Cardiol., Vol. 48:319-321, 2006; Hausleiter et al., J. Am. Coll. Cardiol., Vol. 48:312-318, 2006).

In some embodiments of the methods of the invention, the RNAi construct is administered in combination with another therapeutic agent, such as a therapeutic agent for treating or preventing cardiovascular disease. In one embodiment, an RNAi construct of the invention is administered alone or in combination with other agents useful for treating the condition with which the patient is afflicted. Examples of such agents include both proteinaceous and non-proteinaceous drugs. When multiple therapeutics are co-administered, dosages may be adjusted accordingly, as is recognized in the pertinent art. "Co-administration" and combination therapy are not limited to simultaneous administration, but also include treatment regimens in which an RNAi construct of the invention is administered at least once during a course of treatment that involves administering at least one other therapeutic agent to the patient. In certain embodiments, an RNAi construct of the invention is administered prior to the administration of at least one other therapeutic agent. In other embodiments, an RNAi construct of the invention is administered concurrent with the administration of at least one other therapeutic agent. In some embodiments, an RNAi construct of the invention is administered subsequent to the administration of at least one other therapeutic agent.

In certain embodiments of the methods of the invention, the RNAi construct is administered to a patient in combination with a PCSK9 antagonist, such as an anti-hPCSK9 antibody (e.g., Repatha® (evolocumab)). In another embodiment, the RNAi construct of the invention is administered to a patient in combination with at least one other cholesterol-lowering (serum and/or total body cholesterol) agent. In some embodiments, the agent increases the expression of LDLR, has been observed to increase serum HDL levels, lower LDL levels, or lower triglyceride levels. Exemplary agents include, but are not limited to, statins (e.g., atorvastatin, cerivastatin, fluvastatin, lovastatin, mevastatin, pitavastatin, pravastatin, rosuvastatin, simvastatin); nicotinic acid (Niacin) (NIACOR, NIASPAN (slow release niacin), SLO-NIACIN (slow release niacin)); fibric acid (LOPID (Gemfibrozil), TRICOR (fenofibrate)); bile acid sequestrants (QUESTRAN (cholestyramine), colesevelam (WELCHOL), COLESTID (colestipol)); cholesterol absorption inhibitors (ZETIA (ezetimibe)), combining nicotinic acid with statin (ADVICOR (LOVASTATIN and NIASPAN), combinations of a statin with an absorption inhibitor (VYTORIN (ZOCOR and ZETIA); and/or lipid modifying agents.

In some embodiments, the RNAi construct of the invention is combined with PPAR gamma agonists, PPAR alpha/gamma agonists, squalene synthase inhibitors, CETP inhibitors, anti-hypertensives, anti-diabetic agents (such as sulphonyl ureas, insulin, GLP-1 analogs, DDPIV inhibitors), ApoB modulators, MTP inhibitors and/or arteriosclerosis obliterans treatments. In certain embodiments, the RNAi construct of the invention is combined with an agent that increases the level of LDL receptor (LDLR) protein in a patient, such as statins, certain cytokines, like oncostatin M, estrogen, and/or certain herbal ingredients, such as berberine.

In some embodiments, the RNAi construct of the invention is combined with an agent that increases serum cholesterol levels in a patient (such as certain anti-psycotic agents, certain HIV protease inhibitors, dietary factors such as high fructose, sucrose, cholesterol or certain fatty acids and certain nuclear receptor agonists and antagonists for RXR, RAR, LXR, FXR). In certain embodiments, the RNAi construct of the invention is combined with an agent that increases the level of PCSK9 protein in a subject, such as statins and/or insulin. The administration of RNAi constructs in such embodiments can allow for the RNAi construct to mitigate the undesirable side-effects of these other agents, such as increases in serum non-HDL cholesterol.

It is understood that all ribonucleic acid sequences disclosed herein can be converted to deoxyribonucleic acid sequences by substituting a thymine base for a uracil base in the sequence. Likewise, all deoxyribonucleic acid sequences disclosed herein can be converted to ribonucleic acid sequences by substituting a uracil base for a thymine base in the sequence. Deoxyribonucleic acid sequences, ribonucleic acid sequences, and sequences containing mixtures of deoxyribonucleotides and ribonucleotides of all sequences disclosed herein are included in the invention.

Additionally, any nucleic acid sequences disclosed herein may be modified with any combination of chemical modifications. One of skill in the art will readily appreciate that such designation as "RNA" or "DNA" to describe modified polynucleotides is, in certain instances, arbitrary. For example, a polynucleotide comprising a nucleotide having a 2'-OH substituent on the ribose sugar and a thymine base could be described as a DNA molecule having a modified sugar (2'-OH for the natural 2'-H of DNA) or as an RNA molecule having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of a further example and without limitation, a polynucleotide having the sequence "ATCGATCG" encompasses any polynucleotides having such a sequence, whether modified or unmodified, including, but not limited to, such compounds comprising RNA bases, such as those having sequence "AUCGAUCG" and those having some DNA bases and some RNA bases such as "AUCGATCG" and polynucleotides having other modified bases, such as "ATmeCGAUCG," wherein meC indicates a cytosine base comprising a methyl group at the 5-position.

The following examples, including the experiments conducted and the results achieved, are provided for illustrative purposes only and are not to be construed as limiting the scope of the appended claims.

EXAMPLES

Example 1. Selection and Design of ASGR1 siRNA Sequences

The identification and selection of optimal sequences for therapeutic siRNA molecules targeting the human asialoglycoprotein receptor 1 (ASGR1) proceeded in two phases. Candidate sequences for inclusion in an initial Tier 1 screening set were identified using a bioinformatics analysis of two alternatively spliced transcripts for human ASGR1: transcript variant 1 encoding the longer isoform A (NCBI Reference Sequence No. NM_001671.4; see FIG. 1A) and transcript variant 2 encoding the shorter isoform B (NCBI Reference Sequence No. NM_001197216.2; see FIG. 1B). The two human ASGR1 transcript sequences were analyzed using an in-house siRNA design algorithm, which identifies 19mer sequences having a particular base content at certain positions or regions within the 19mer sequences. Sequences were also evaluated for identity to ASGR1 sequences in the mouse (NCBI Reference No. NM_009714.2; see FIG. 2), rat (FIG. 3), and cynomolgus monkey (NCBI Reference No. XM_005582698.1; see FIG. 4). 19mer sequences were also evaluated for sequence identity to other human gene sequences to predict off-target effects and for overlap with known single nucleotide polymorphisms. Based on the results of the bioinformatics analysis, 211 sequences were included in the Tier 1 screening set. A UU dinucleotide was added to the 3' end of the selected 19mer sense and antisense sequences to produce siRNA molecules with 19 base pair duplex regions and a 2 nucleotide overhang at the 3' ends of both strands.

The second phase of siRNA sequence selection was directed to identifying additional active siRNAs targeting the human ASGR1 mRNA that may have been excluded as a result of the bioinformatics analysis. All overlapping 19mer sequences from the human ASGR1 transcript variants 1 and 2 (NCBI Reference Sequence Nos. NM_001671.4 and NM_001197216.2; see FIGS. 1A and 1B) were extracted and reverse complement antisense sequences designed. 1284 sequences that were not included in Tier 1 were included as part of the Tier 2 sequences. Like the Tier 1 sequences, the Tier 2 sequences were converted to 21mers by adding a UU dinucleotide to the 3' ends of the sense and antisense strand to produce siRNA molecules with 19 base pair duplex regions and 2 nucleotide overhangs at each 3' end. Tier 2 also included 55 sequences identified in Tier 1 for resynthesis and testing. The combined Tier 1 and Tier 2 screening sets included 1495 19mer sequences across the human ASGR1 mRNA transcripts. The sense and antisense sequences of the siRNA molecules included in both Tier 1 and Tier 2 screening sets, as well as the sequences for 8 additional siRNA molecules that target the terminal regions of the transcripts, are shown in Table 1 below. The site within each of the human ASGR1 transcripts that is targeted by each of the siRNA molecules is also listed in Table 1.

TABLE 1

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1000 | 1000-1018 | 883-901 | UGUCCAGCACCACAUAGGCUU | 5 | GCCUAUGUGGUGCUGGACAUU | 1508 |
| D-1001 | 1001-1019 | 884-902 | GUCCAGCACCACAUAGGCCUU | 6 | GGCCUAUGUGGUGCUGGACUU | 1509 |
| D-1002 | 100-118 | 100-118 | CACCCCCACACUCCCCUAAUU | 7 | UUAGGGGAGUGUGGGGGUGUU | 1510 |
| D-1003 | 1002-1020 | 885-903 | UCCAGCACCACAUAGGCCCUU | 8 | GGGCCUAUGUGGUGCUGGAUU | 1511 |
| D-1004 | 1003-1021 | 886-904 | CCAGCACCACAUAGGCCCUUU | 9 | AGGGCCUAUGUGGUGCUGGUU | 1512 |
| D-1005 | 1004-1022 | 887-905 | CAGCACCACAUAGGCCCUGUU | 10 | CAGGGCCUAUGUGGUGCUGUU | 1513 |
| D-1006 | 1005-1023 | 888-906 | AGCACCACAUAGGCCCUGUUU | 11 | ACAGGGCCUAUGUGGUGCUUU | 1514 |
| D-1007 | 1006-1024 | 889-907 | GCACCACAUAGGCCCUGUGUU | 12 | CACAGGGCCUAUGUGGUGCUU | 1515 |
| D-1008 | 1007-1025 | 890-908 | CACCACAUAGGCCCUGUGAUU | 13 | UCACAGGGCCUAUGUGGUGUU | 1516 |
| D-1009 | 1008-1026 | 891-909 | ACCACAUAGGCCCUGUGAAUU | 14 | UUCACAGGGCCUAUGUGGUUU | 1517 |
| D-1010 | 1009-1027 | 892-910 | CCACAUAGGCCCUGUGAACUU | 15 | GUUCACAGGGCCUAUGUGGUU | 1518 |
| D-1011 | 1010-1028 | 893-911 | CACAUAGGCCCUGUGAACAUU | 16 | UGUUCACAGGGCCUAUGUGUU | 1519 |
| D-1012 | 1011-1029 | 894-912 | ACAUAGGCCCUGUGAACACUU | 17 | GUGUUCACAGGGCCUAUGUUU | 1520 |
| D-1013 | 101-119 | 101-119 | ACCCCCACACUCCCCUAAGUU | 18 | CUUAGGGGAGUGUGGGGGUUU | 1521 |
| D-1014 | 1012-1030 | 895-913 | CAUAGGCCCUGUGAACACCUU | 19 | GGUGUUCACAGGGCCUAUGUU | 1522 |
| D-1015 | 1013-1031 | 896-914 | AUAGGCCCUGUGAACACCUUU | 20 | AGGUGUUCACAGGGCCUAUUU | 1523 |
| D-1016 | 1014-1032 | 897-915 | UAGGCCCUGUGAACACCUGUU | 21 | CAGGUGUUCACAGGGCCUAUU | 1524 |
| D-1017 | 1015-1033 | 898-916 | AGGCCCUGUGAACACCUGGUU | 22 | CCAGGUGUUCACAGGGCCUUU | 1525 |
| D-1018 | 1016-1034 | 899-917 | GGCCCUGUGAACACCUGGAUU | 23 | UCCAGGUGUUCACAGGGCCUU | 1526 |
| D-1019 | 1017-1035 | 900-918 | GCCCUGUGAACACCUGGAUUU | 24 | AUCCAGGUGUUCACAGGGCUU | 1527 |
| D-1020 | 1018-1036 | 901-919 | CCCUGUGAACACCUGGAUGUU | 25 | CAUCCAGGUGUUCACAGGGUU | 1528 |
| D-1021 | 1019-1037 | 902-920 | CCUGUGAACACCUGGAUGGUU | 26 | CCAUCCAGGUGUUCACAGGUU | 1529 |
| D-1022 | 1020-1038 | 903-921 | CUGUGAACACCUGGAUGGGUU | 27 | CCCAUCCAGGUGUUCACAGUU | 1530 |
| D-1023 | 1021-1039 | 904-922 | UGUGAACACCUGGAUGGGCUU | 28 | GCCCAUCCAGGUGUUCACAUU | 1531 |
| D-1024 | 102-120 | 102-120 | CCCCCACACUCCCCUAAGUUU | 29 | ACUUAGGGGAGUGUGGGGGUU | 1532 |
| D-1025 | 1022-1040 | 905-923 | GUGAACACCUGGAUGGGCCUU | 30 | GGCCCAUCCAGGUGUUCACUU | 1533 |
| D-1026 | 1023-1041 | 906-924 | UGAACACCUGGAUGGGCCUUU | 31 | AGGCCCAUCCAGGUGUUCAUU | 1534 |
| D-1027 | 1024-1042 | 907-925 | GAACACCUGGAUGGGCCUCUU | 32 | GAGGCCCAUCCAGGUGUUCUU | 1535 |
| D-1028 | 1025-1043 | 908-926 | AACACCUGGAUGGGCCUCCUU | 33 | GGAGGCCCAUCCAGGUGUUUU | 1536 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1029 | 1026-1044 | 909-927 | ACACCUGGAUGGGCCUCCAUU | 34 | UGGAGGCCCAUCCAGGUGUUU | 1537 |
| D-1030 | 1027-1045 | 910-928 | CACCUGGAUGGGCCUCCACUU | 35 | GUGGAGGCCCAUCCAGGUGUU | 1538 |
| D-1031 | 10-28 | 10-28 | UGCACGGAAGAGUGAGGUGUU | 36 | CACCUCACUCUUCCGUGCAUU | 1539 |
| D-1032 | 1028-1046 | 911-929 | ACCUGGAUGGGCCUCCACGUU | 37 | CGUGGAGGCCCAUCCAGGUUU | 1540 |
| D-1033 | 1029-1047 | 912-930 | CCUGGAUGGGCCUCCACGAUU | 38 | UCGUGGAGGCCCAUCCAGGUU | 1541 |
| D-1034 | 1030-1048 | 913-931 | CUGGAUGGGCCUCCACGACUU | 39 | GUCGUGGAGGCCCAUCCAGUU | 1542 |
| D-1035 | 1031-1049 | 914-932 | UGGAUGGGCCUCCACGACCUU | 40 | GGUCGUGGAGGCCCAUCCAUU | 1543 |
| D-1036 | 103-121 | 103-121 | CCCCACACUCCCCUAAGUUUU | 41 | AACUUAGGGGAGUGUGGGGUU | 1544 |
| D-1037 | 1032-1050 | 915-933 | GGAUGGGCCUCCACGACCAUU | 42 | UGGUCGUGGAGGCCCAUCCUU | 1545 |
| D-1038 | 1033-1051 | 916-934 | GAUGGGCCUCCACGACCAAUU | 43 | UUGGUCGUGGAGGCCCAUCUU | 1546 |
| D-1039 | 1034-1052 | 917-935 | AUGGGCCUCCACGACCAAAUU | 44 | UUUGGUCGUGGAGGCCCAUUU | 1547 |
| D-1040 | 1035-1053 | 918-936 | UGGGCCUCCACGACCAAAAUU | 45 | UUUUGGUCGUGGAGGCCCAUU | 1548 |
| D-1041 | 1036-1054 | 919-937 | GGGCCUCCACGACCAAAACUU | 46 | GUUUUGGUCGUGGAGGCCCUU | 1549 |
| D-1042 | 1037-1055 | 920-938 | GGCCUCCACGACCAAAACGUU | 47 | CGUUUUGGUCGUGGAGGCCUU | 1550 |
| D-1043 | 1038-1056 | 921-939 | GCCUCCACGACCAAAACGGUU | 48 | CCGUUUUGGUCGUGGAGGCUU | 1551 |
| D-1044 | 1039-1057 | 922-940 | CCUCCACGACCAAAACGGGUU | 49 | CCCGUUUUGGUCGUGGAGGUU | 1552 |
| D-1045 | 1040-1058 | 923-941 | CUCCACGACCAAAACGGGCUU | 50 | GCCCGUUUUGGUCGUGGAGUU | 1553 |
| D-1046 | 1041-1059 | 924-942 | UCCACGACCAAAACGGGCCUU | 51 | GGCCCGUUUUGGUCGUGGAUU | 1554 |
| D-1047 | 104-122 | 104-122 | CCCACACUCCCCUAAGUUCUU | 52 | GAACUUAGGGGAGUGUGGGUU | 1555 |
| D-1048 | 1042-1060 | 925-943 | CCACGACCAAAACGGGCCCUU | 53 | GGGCCCGUUUUGGUCGUGGUU | 1556 |
| D-1049 | 1043-1061 | 926-944 | CACGACCAAAACGGGCCCUUU | 54 | AGGGCCCGUUUUGGUCGUGUU | 1557 |
| D-1050 | 1044-1062 | 927-945 | ACGACCAAAACGGGCCCUGUU | 55 | CAGGGCCCGUUUUGGUCGUUU | 1558 |
| D-1051 | 1045-1063 | 928-946 | CGACCAAAACGGGCCCUGGUU | 56 | CCAGGGCCCGUUUUGGUCGUU | 1559 |
| D-1052 | 1046-1064 | 929-947 | GACCAAAACGGGCCCUGGAUU | 57 | UCCAGGGCCCGUUUUGGUCUU | 1560 |
| D-1053 | 1047-1065 | 930-948 | ACCAAAACGGGCCCUGGAAUU | 58 | UUCCAGGGCCCGUUUUGGUUU | 1561 |
| D-1054 | 1048-1066 | 931-949 | CCAAAACGGGCCCUGGAAGUU | 59 | CUUCCAGGGCCCGUUUUGGUU | 1562 |
| D-1055 | 1049-1067 | 932-950 | CAAAACGGGCCCUGGAAGUUU | 60 | ACUUCCAGGGCCCGUUUUGUU | 1563 |
| D-1056 | 1050-1068 | 933-951 | AAAACGGGCCCUGGAAGUGUU | 61 | CACUUCCAGGGCCCGUUUUUU | 1564 |
| D-1057 | 1051-1069 | 934-952 | AAACGGGCCCUGGAAGUGGUU | 62 | CCACUUCCAGGGCCCGUUUUU | 1565 |
| D-1058 | 105-123 | 105-123 | CCACACUCCCCUAAGUUCCUU | 63 | GGAACUUAGGGGAGUGUGGUU | 1566 |
| D-1059 | 1052-1070 | 935-953 | AACGGGCCCUGGAAGUGGGUU | 64 | CCCACUUCCAGGGCCCGUUUU | 1567 |
| D-1060 | 1053-1071 | 936-954 | ACGGGCCCUGGAAGUGGGUUU | 65 | ACCCACUUCCAGGGCCCGUUU | 1568 |
| D-1061 | 1054-1072 | 937-955 | CGGGCCCUGGAAGUGGGUGUU | 66 | CACCCACUUCCAGGGCCCGUU | 1569 |
| D-1062 | 1055-1073 | 938-956 | GGGCCCUGGAAGUGGGUGGUU | 67 | CCACCCACUUCCAGGGCCCUU | 1570 |
| D-1063 | 1056-1074 | 939-957 | GGCCCUGGAAGUGGGUGGAUU | 68 | UCCACCCACUUCCAGGGCCUU | 1571 |
| D-1064 | 1057-1075 | 940-958 | GCCCUGGAAGUGGGUGGACUU | 69 | GUCCACCCACUUCCAGGGCUU | 1572 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1065 | 1058-1076 | 941-959 | CCCUGGAAGUGGGUGGACGUU | 70 | CGUCCACCCACUUCCAGGGUU | 1573 |
| D-1066 | 1059-1077 | 942-960 | CCUGGAAGUGGGUGGACGGUU | 71 | CCGUCCACCCACUUCCAGGUU | 1574 |
| D-1067 | 1060-1078 | 943-961 | CUGGAAGUGGGUGGACGGGUU | 72 | CCCGUCCACCCACUUCCAGUU | 1575 |
| D-1068 | 1061-1079 | 944-962 | UGGAAGUGGGUGGACGGGAUU | 73 | UCCCGUCCACCCACUUCCAUU | 1576 |
| D-1069 | 106-124 | 106-124 | CACACUCCCCUAAGUUCCAUU | 74 | UGGAACUUAGGGGAGUGUGUU | 1577 |
| D-1070 | 1062-1080 | 945-963 | GGAAGUGGGUGGACGGGACUU | 75 | GUCCCGUCCACCCACUUCCUU | 1578 |
| D-1071 | 1063-1081 | 946-964 | GAAGUGGGUGGACGGGACGUU | 76 | CGUCCCGUCCACCCACUUCUU | 1579 |
| D-1072 | 1064-1082 | 947-965 | AAGUGGGUGGACGGGACGGUU | 77 | CCGUCCCGUCCACCCACUUUU | 1580 |
| D-1073 | 1065-1083 | 948-966 | AGUGGGUGGACGGGACGGAUU | 78 | UCCGUCCCGUCCACCCACUUU | 1581 |
| D-1074 | 1066-1084 | 949-967 | GUGGGUGGACGGGACGGACUU | 79 | GUCCGUCCCGUCCACCCACUU | 1582 |
| D-1075 | 1067-1085 | 950-968 | UGGGUGGACGGGACGGACUUU | 80 | AGUCCGUCCCGUCCACCCAUU | 1583 |
| D-1076 | 1068-1086 | 951-969 | GGGUGGACGGGACGGACUAUU | 81 | UAGUCCGUCCCGUCCACCCUU | 1584 |
| D-1077 | 1069-1087 | 952-970 | GGUGGACGGGACGGACUACUU | 82 | GUAGUCCGUCCCGUCCACCUU | 1585 |
| D-1078 | 1070-1088 | 953-971 | GUGGACGGGACGGACUACGUU | 83 | CGUAGUCCGUCCCGUCCACUU | 1586 |
| D-1079 | 1071-1089 | 954-972 | UGGACGGGACGGACUACGAUU | 84 | UCGUAGUCCGUCCCGUCCAUU | 1587 |
| D-1080 | 107-125 | 107-125 | ACACUCCCCUAAGUUCCAAUU | 85 | UUGGAACUUAGGGGAGUGUUU | 1588 |
| D-1081 | 1072-1090 | 955-973 | GGACGGGACGGACUACGAGUU | 86 | CUCGUAGUCCGUCCCGUCCUU | 1589 |
| D-1082 | 1073-1091 | 956-974 | GACGGGACGGACUACGAGAUU | 87 | UCUCGUAGUCCGUCCCGUCUU | 1590 |
| D-1083 | 1074-1092 | 957-975 | ACGGGACGGACUACGAGACUU | 88 | GUCUCGUAGUCCGUCCCGUUU | 1591 |
| D-1084 | 1075-1093 | 958-976 | CGGGACGGACUACGAGACGUU | 89 | CGUCUCGUAGUCCGUCCCGUU | 1592 |
| D-1085 | 1076-1094 | 959-977 | GGGACGGACUACGAGACGGUU | 90 | CCGUCUCGUAGUCCGUCCCUU | 1593 |
| D-1086 | 1077-1095 | 960-978 | GGACGGACUACGAGACGGGUU | 91 | CCCGUCUCGUAGUCCGUCCUU | 1594 |
| D-1087 | 1078-1096 | 961-979 | GACGGACUACGAGACGGGCUU | 92 | GCCCGUCUCGUAGUCCGUCUU | 1595 |
| D-1088 | 1079-1097 | 962-980 | ACGGACUACGAGACGGGCUUU | 93 | AGCCCGUCUCGUAGUCCGUUU | 1596 |
| D-1089 | 1080-1098 | 963-981 | CGGACUACGAGACGGGCUUUU | 94 | AAGCCCGUCUCGUAGUCCGUU | 1597 |
| D-1090 | 1081-1099 | 964-982 | GGACUACGAGACGGGCUUCUU | 95 | GAAGCCCGUCUCGUAGUCCUU | 1598 |
| D-1091 | 108-126 | 108-126 | CACUCCCCUAAGUUCCAAUUU | 96 | AUUGGAACUUAGGGGAGUGUU | 1599 |
| D-1092 | 1082-1100 | 965-983 | GACUACGAGACGGGCUUCAUU | 97 | UGAAGCCCGUCUCGUAGUCUU | 1600 |
| D-1093 | 1083-1101 | 966-984 | ACUACGAGACGGGCUUCAAUU | 98 | UUGAAGCCCGUCUCGUAGUUU | 1601 |
| D-1094 | 1084-1102 | 967-985 | CUACGAGACGGGCUUCAAGUU | 99 | CUUGAAGCCCGUCUCGUAGUU | 1602 |
| D-1095 | 1085-1103 | 968-986 | UACGAGACGGGCUUCAAGAUU | 100 | UCUUGAAGCCCGUCUCGUAUU | 1603 |
| D-1096 | 1086-1104 | 969-987 | ACGAGACGGGCUUCAAGAAUU | 101 | UUCUUGAAGCCCGUCUCGUUU | 1604 |
| D-1097 | 1087-1105 | 970-988 | CGAGACGGGCUUCAAGAACUU | 102 | GUUCUUGAAGCCCGUCUCGUU | 1605 |
| D-1098 | 1088-1106 | 971-989 | GAGACGGGCUUCAAGAACUUU | 103 | AGUUCUUGAAGCCCGUCUCUU | 1606 |
| D-1099 | 1089-1107 | 972-990 | AGACGGGCUUCAAGAACUGUU | 104 | CAGUUCUUGAAGCCCGUCUUU | 1607 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1100 | 1090-1108 | 973-991 | GACGGGCUUCAAGAACUGGUU | 105 | CCAGUUCUUGAAGCCCGUCUU | 1608 |
| D-1101 | 1091-1109 | 974-992 | ACGGGCUUCAAGAACUGGAUU | 106 | UCCAGUUCUUGAAGCCCGUUU | 1609 |
| D-1102 | 109-127 | 109-127 | ACUCCCCUAAGUUCCAAUCUU | 107 | GAUUGGAACUUAGGGGAGUUU | 1610 |
| D-1103 | 1092-1110 | 975-993 | CGGGCUUCAAGAACUGGAGUU | 108 | CUCCAGUUCUUGAAGCCCGUU | 1611 |
| D-1104 | 1093-1111 | 976-994 | GGGCUUCAAGAACUGGAGGUU | 109 | CCUCCAGUUCUUGAAGCCCUU | 1612 |
| D-1105 | 1094-1112 | 977-995 | GGCUUCAAGAACUGGAGGCUU | 110 | GCCUCCAGUUCUUGAAGCCUU | 1613 |
| D-1106 | 1095-1113 | 978-996 | GCUUCAAGAACUGGAGGCCUU | 111 | GGCCUCCAGUUCUUGAAGCUU | 1614 |
| D-1107 | 1096-1114 | 979-997 | CUUCAAGAACUGGAGGCCGUU | 112 | CGGCCUCCAGUUCUUGAAGUU | 1615 |
| D-1108 | 1097-1115 | 980-998 | UUCAAGAACUGGAGGCCGGUU | 113 | CCGGCCUCCAGUUCUUGAAUU | 1616 |
| D-1109 | 1098-1116 | 981-999 | UCAAGAACUGGAGGCCGGAUU | 114 | UCCGGCCUCCAGUUCUUGAUU | 1617 |
| D-1110 | 1099-1117 | 982-1000 | CAAGAACUGGAGGCCGGAGUU | 115 | CUCCGGCCUCCAGUUCUUGUU | 1618 |
| D-1111 | 1100-1118 | 983-1001 | AAGAACUGGAGGCCGGAGCUU | 116 | GCUCCGGCCUCCAGUUCUUUU | 1619 |
| D-1112 | 1101-1119 | 984-1002 | AGAACUGGAGGCCGGAGCAUU | 117 | UGCUCCGGCCUCCAGUUCUUU | 1620 |
| D-1113 | 110-128 | 110-128 | CUCCCCUAAGUUCCAAUCCUU | 118 | GGAUUGGAACUUAGGGGAGUU | 1621 |
| D-1114 | 1102-1120 | 985-1003 | GAACUGGAGGCCGGAGCAGUU | 119 | CUGCUCCGGCCUCCAGUUCUU | 1622 |
| D-1115 | 1103-1121 | 986-1004 | AACUGGAGGCCGGAGCAGCUU | 120 | GCUGCUCCGGCCUCCAGUUUU | 1623 |
| D-1116 | 1104-1122 | 987-1005 | ACUGGAGGCCGGAGCAGCCUU | 121 | GGCUGCUCCGGCCUCCAGUUU | 1624 |
| D-1117 | 1105-1123 | 988-1006 | CUGGAGGCCGGAGCAGCCGUU | 122 | CGGCUGCUCCGGCCUCCAGUU | 1625 |
| D-1118 | 1106-1124 | 989-1007 | UGGAGGCCGGAGCAGCCGGUU | 123 | CCGGCUGCUCCGGCCUCCAUU | 1626 |
| D-1119 | 1107-1125 | 990-1008 | GGAGGCCGGAGCAGCCGGAUU | 124 | UCCGGCUGCUCCGGCCUCCUU | 1627 |
| D-1120 | 1108-1126 | 991-1009 | GAGGCCGGAGCAGCCGGACUU | 125 | GUCCGGCUGCUCCGGCCUCUU | 1628 |
| D-1121 | 1109-1127 | 992-1010 | AGGCCGGAGCAGCCGGACGUU | 126 | CGUCCGGCUGCUCCGGCCUUU | 1629 |
| D-1122 | 1110-1128 | 993-1011 | GGCCGGAGCAGCCGGACGAUU | 127 | UCGUCCGGCUGCUCCGGCCUU | 1630 |
| D-1123 | 1111-1129 | 994-1012 | GCCGGAGCAGCCGGACGACUU | 128 | GUCGUCCGGCUGCUCCGGCUU | 1631 |
| D-1124 | 111-129 | 111-129 | UCCCCUAAGUUCCAAUCCAUU | 129 | UGGAUUGGAACUUAGGGGAUU | 1632 |
| D-1125 | 1112-1130 | 995-1013 | CCGGAGCAGCCGGACGACUUU | 130 | AGUCGUCCGGCUGCUCCGGUU | 1633 |
| D-1126 | 1113-1131 | 996-1014 | CGGAGCAGCCGGACGACUGUU | 131 | CAGUCGUCCGGCUGCUCCGUU | 1634 |
| D-1127 | 1114-1132 | 997-1015 | GGAGCAGCCGGACGACUGGUU | 132 | CCAGUCGUCCGGCUGCUCCUU | 1635 |
| D-1128 | 1115-1133 | 998-1016 | GAGCAGCCGGACGACUGGUUU | 133 | ACCAGUCGUCCGGCUGCUCUU | 1636 |
| D-1129 | 1116-1134 | 999-1017 | AGCAGCCGGACGACUGGUAUU | 134 | UACCAGUCGUCCGGCUGCUUU | 1637 |
| D-1130 | 1117-1135 | 1000-1018 | GCAGCCGGACGACUGGUACUU | 135 | GUACCAGUCGUCCGGCUGCUU | 1638 |
| D-1131 | 1118-1136 | 1001-1019 | CAGCCGGACGACUGGUACGUU | 136 | CGUACCAGUCGUCCGGCUGUU | 1639 |
| D-1132 | 1119-1137 | 1002-1020 | AGCCGGACGACUGGUACGGUU | 137 | CCGUACCAGUCGUCCGGCUUU | 1640 |
| D-1133 | 1120-1138 | 1003-1021 | GCCGGACGACUGGUACGGCUU | 138 | GCCGUACCAGUCGUCCGGCUU | 1641 |
| D-1134 | 1121-1139 | 1004-1022 | CCGGACGACUGGUACGGCCUU | 139 | GGCCGUACCAGUCGUCCGGUU | 1642 |
| D-1135 | 112-130 | 112-130 | CCCCUAAGUUCCAAUCCAUUU | 140 | AUGGAUUGGAACUUAGGGGUU | 1643 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1136 | 1122-1140 | 1005-1023 | CGGACGACUGGUACGGCCAUU | 141 | UGGCCGUACCAGUCGUCCGUU | 1644 |
| D-1137 | 1123-1141 | 1006-1024 | GGACGACUGGUACGGCCACUU | 142 | GUGGCCGUACCAGUCGUCCUU | 1645 |
| D-1138 | 1124-1142 | 1007-1025 | GACGACUGGUACGGCCACGUU | 143 | CGUGGCCGUACCAGUCGUCUU | 1646 |
| D-1139 | 1125-1143 | 1008-1026 | ACGACUGGUACGGCCACGGUU | 144 | CCGUGGCCGUACCAGUCGUUU | 1647 |
| D-1140 | 1126-1144 | 1009-1027 | CGACUGGUACGGCCACGGGUU | 145 | CCCGUGGCCGUACCAGUCGUU | 1648 |
| D-1141 | 1127-1145 | 1010-1028 | GACUGGUACGGCCACGGGCUU | 146 | GCCCGUGGCCGUACCAGUCUU | 1649 |
| D-1142 | 1128-1146 | 1011-1029 | ACUGGUACGGCCACGGGCUUU | 147 | AGCCCGUGGCCGUACCAGUUU | 1650 |
| D-1143 | 11-29 | 11-29 | GCACGGAAGAGUGAGGUGAUU | 148 | UCACCUCACUCUUCCGUGCUU | 1651 |
| D-1144 | 1129-1147 | 1012-1030 | CUGGUACGGCCACGGGCUCUU | 149 | GAGCCCGUGGCCGUACCAGUU | 1652 |
| D-1145 | 1130-1148 | 1013-1031 | UGGUACGGCCACGGGCUCGUU | 150 | CGAGCCCGUGGCCGUACCAUU | 1653 |
| D-1146 | 1131-1149 | 1014-1032 | GGUACGGCCACGGGCUCGGUU | 151 | CCGAGCCCGUGGCCGUACCUU | 1654 |
| D-1147 | 113-131 | 113-131 | CCCUAAGUUCCAAUCCAUUUU | 152 | AAUGGAUUGGAACUUAGGGUU | 1655 |
| D-1148 | 1132-1150 | 1015-1033 | GUACGGCCACGGGCUCGGAUU | 153 | UCCGAGCCCGUGGCCGUACUU | 1656 |
| D-1149 | 1133-1151 | 1016-1034 | UACGGCCACGGGCUCGGAGUU | 154 | CUCCGAGCCCGUGGCCGUAUU | 1657 |
| D-1150 | 1134-1152 | 1017-1035 | ACGGCCACGGGCUCGGAGGUU | 155 | CCUCCGAGCCCGUGGCCGUUU | 1658 |
| D-1151 | 1135-1153 | 1018-1036 | CGGCCACGGGCUCGGAGGAUU | 156 | UCCUCCGAGCCCGUGGCCGUU | 1659 |
| D-1152 | 1136-1154 | 1019-1037 | GGCCACGGGCUCGGAGGAGUU | 157 | CUCCUCCGAGCCCGUGGCCUU | 1660 |
| D-1153 | 1137-1155 | 1020-1038 | GCCACGGGCUCGGAGGAGGUU | 158 | CCUCCUCCGAGCCCGUGGCUU | 1661 |
| D-1154 | 1138-1156 | 1021-1039 | CCACGGGCUCGGAGGAGGCUU | 159 | GCCUCCUCCGAGCCCGUGGUU | 1662 |
| D-1155 | 1139-1157 | 1022-1040 | CACGGGCUCGGAGGAGGCGUU | 160 | CGCCUCCUCCGAGCCCGUGUU | 1663 |
| D-1156 | 1140-1158 | 1023-1041 | ACGGGCUCGGAGGAGGCGAUU | 161 | UCGCCUCCUCCGAGCCCGUUU | 1664 |
| D-1157 | 1141-1159 | 1024-1042 | CGGGCUCGGAGGAGGCGAGUU | 162 | CUCGCCUCCUCCGAGCCCGUU | 1665 |
| D-1158 | 114-132 | 114-132 | CCUAAGUUCCAAUCCAUUUUU | 163 | AAAUGGAUUGGAACUUAGGUU | 1666 |
| D-1159 | 1142-1160 | 1025-1043 | GGGCUCGGAGGAGGCGAGGUU | 164 | CCUCGCCUCCUCCGAGCCCUU | 1667 |
| D-1160 | 1143-1161 | 1026-1044 | GGCUCGGAGGAGGCGAGGAUU | 165 | UCCUCGCCUCCUCCGAGCCUU | 1668 |
| D-1161 | 1144-1162 | 1027-1045 | GCUCGGAGGAGGCGAGGACUU | 166 | GUCCUCGCCUCCUCCGAGCUU | 1669 |
| D-1162 | 1145-1163 | 1028-1046 | CUCGGAGGAGGCGAGGACUUU | 167 | AGUCCUCGCCUCCUCCGAGUU | 1670 |
| D-1163 | 1146-1164 | 1029-1047 | UCGGAGGAGGCGAGGACUGUU | 168 | CAGUCCUCGCCUCCUCCGAUU | 1671 |
| D-1164 | 1147-1165 | 1030-1048 | CGGAGGAGGCGAGGACUGUUU | 169 | ACAGUCCUCGCCUCCUCCGUU | 1672 |
| D-1165 | 1148-1166 | 1031-1049 | GGAGGAGGCGAGGACUGUGUU | 170 | CACAGUCCUCGCCUCCUCCUU | 1673 |
| D-1166 | 1149-1167 | 1032-1050 | GAGGAGGCGAGGACUGUGCUU | 171 | GCACAGUCCUCGCCUCCUCUU | 1674 |
| D-1167 | 1150-1168 | 1033-1051 | AGGAGGCGAGGACUGUGCCUU | 172 | GGCACAGUCCUCGCCUCCUUU | 1675 |
| D-1168 | 1151-1169 | 1034-1052 | GGAGGCGAGGACUGUGCCCUU | 173 | GGGCACAGUCCUCGCCUCCUU | 1676 |
| D-1169 | 115-133 | 115-133 | CUAAGUUCCAAUCCAUUUCUU | 174 | GAAAUGGAUUGGAACUUAGUU | 1677 |
| D-1170 | 1152-1170 | 1035-1053 | GAGGCGAGGACUGUGCCCAUU | 175 | UGGGCACAGUCCUCGCCUCUU | 1678 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1171 | 1153-1171 | 1036-1054 | AGGCGAGGACUGUGCCCACUU | 176 | GUGGGCACAGUCCUCGCCUUU | 1679 |
| D-1172 | 1154-1172 | 1037-1055 | GGCGAGGACUGUGCCCACUUU | 177 | AGUGGGCACAGUCCUCGCCUU | 1680 |
| D-1173 | 1155-1173 | 1038-1056 | GCGAGGACUGUGCCCACUUUU | 178 | AAGUGGGCACAGUCCUCGCUU | 1681 |
| D-1174 | 1156-1174 | 1039-1057 | CGAGGACUGUGCCCACUUCUU | 179 | GAAGUGGGCACAGUCCUCGUU | 1682 |
| D-1175 | 1157-1175 | 1040-1058 | GAGGACUGUGCCCACUUCAUU | 180 | UGAAGUGGGCACAGUCCUCUU | 1683 |
| D-1176 | 1158-1176 | 1041-1059 | AGGACUGUGCCCACUUCACUU | 181 | GUGAAGUGGGCACAGUCCUUU | 1684 |
| D-1177 | 1159-1177 | 1042-1060 | GGACUGUGCCCACUUCACCUU | 182 | GGUGAAGUGGGCACAGUCCUU | 1685 |
| D-1178 | 1160-1178 | 1043-1061 | GACUGUGCCCACUUCACCGUU | 183 | CGGUGAAGUGGGCACAGUCUU | 1686 |
| D-1179 | 1161-1179 | 1044-1062 | ACUGUGCCCACUUCACCGAUU | 184 | UCGGUGAAGUGGGCACAGUUU | 1687 |
| D-1180 | 116-134 | 116-134 | UAAGUUCCAAUCCAUUUCCUU | 185 | GGAAAUGGAUUGGAACUUAUU | 1688 |
| D-1181 | 1162-1180 | 1045-1063 | CUGUGCCCACUUCACCGACUU | 186 | GUCGGUGAAGUGGGCACAGUU | 1689 |
| D-1182 | 1163-1181 | 1046-1064 | UGUGCCCACUUCACCGACGUU | 187 | CGUCGGUGAAGUGGGCACAUU | 1690 |
| D-1183 | 1164-1182 | 1047-1065 | GUGCCCACUUCACCGACGAUU | 188 | UCGUCGGUGAAGUGGGCACUU | 1691 |
| D-1184 | 1165-1183 | 1048-1066 | UGCCCACUUCACCGACGACUU | 189 | GUCGUCGGUGAAGUGGGCAUU | 1692 |
| D-1185 | 1166-1184 | 1049-1067 | GCCCACUUCACCGACGACGUU | 190 | CGUCGUCGGUGAAGUGGGCUU | 1693 |
| D-1186 | 1167-1185 | 1050-1068 | CCCACUUCACCGACGACGGUU | 191 | CCGUCGUCGGUGAAGUGGGUU | 1694 |
| D-1187 | 1168-1186 | 1051-1069 | CCACUUCACCGACGACGGCUU | 192 | GCCGUCGUCGGUGAAGUGGUU | 1695 |
| D-1188 | 1169-1187 | 1052-1070 | CACUUCACCGACGACGGCCUU | 193 | GGCCGUCGUCGGUGAAGUGUU | 1696 |
| D-1189 | 1170-1188 | 1053-1071 | ACUUCACCGACGACGGCCGUU | 194 | CGGCCGUCGUCGGUGAAGUUU | 1697 |
| D-1190 | 1171-1189 | 1054-1072 | CUUCACCGACGACGGCCGCUU | 195 | GCGGCCGUCGUCGGUGAAGUU | 1698 |
| D-1191 | 117-135 | 117-135 | AAGUUCCAAUCCAUUUCCAUU | 196 | UGGAAAUGGAUUGGAACUUUU | 1699 |
| D-1192 | 1172-1190 | 1055-1073 | UUCACCGACGACGGCCGCUUU | 197 | AGCGGCCGUCGUCGGUGAAUU | 1700 |
| D-1193 | 1173-1191 | 1056-1074 | UCACCGACGACGGCCGCUGUU | 198 | CAGCGGCCGUCGUCGGUGAUU | 1701 |
| D-1194 | 1174-1192 | 1057-1075 | CACCGACGACGGCCGCUGGUU | 199 | CCAGCGGCCGUCGUCGGUGUU | 1702 |
| D-1195 | 1175-1193 | 1058-1076 | ACCGACGACGGCCGCUGGAUU | 200 | UCCAGCGGCCGUCGUCGGUUU | 1703 |
| D-1196 | 1176-1194 | 1059-1077 | CCGACGACGGCCGCUGGAAUU | 201 | UUCCAGCGGCCGUCGUCGGUU | 1704 |
| D-1197 | 1177-1195 | 1060-1078 | CGACGACGGCCGCUGGAACUU | 202 | GUUCCAGCGGCCGUCGUCGUU | 1705 |
| D-1198 | 1178-1196 | 1061-1079 | GACGACGGCCGCUGGAACGUU | 203 | CGUUCCAGCGGCCGUCGUCUU | 1706 |
| D-1199 | 1179-1197 | 1062-1080 | ACGACGGCCGCUGGAACGAUU | 204 | UCGUUCCAGCGGCCGUCGUUU | 1707 |
| D-1200 | 1180-1198 | 1063-1081 | CGACGGCCGCUGGAACGACUU | 205 | GUCGUUCCAGCGGCCGUCGUU | 1708 |
| D-1201 | 1181-1199 | 1064-1082 | GACGGCCGCUGGAACGACGUU | 206 | CGUCGUUCCAGCGGCCGUCUU | 1709 |
| D-1202 | 118-136 | 118-136 | AGUUCCAAUCCAUUUCCACUU | 207 | GUGGAAAUGGAUUGGAACUUU | 1710 |
| D-1203 | 1182-1200 | 1065-1083 | ACGGCCGCUGGAACGACGAUU | 208 | UCGUCGUUCCAGCGGCCGUUU | 1711 |
| D-1204 | 1183-1201 | 1066-1084 | CGGCCGCUGGAACGACGACUU | 209 | GUCGUCGUUCCAGCGGCCGUU | 1712 |
| D-1205 | 1184-1202 | 1067-1085 | GGCCGCUGGAACGACGACGUU | 210 | CGUCGUCGUUCCAGCGGCCUU | 1713 |
| D-1206 | 1185-1203 | 1068-1086 | GCCGCUGGAACGACGACGUUU | 211 | ACGUCGUCGUUCCAGCGGCUU | 1714 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1207 | 1186-1204 | 1069-1087 | CCGCUGGAACGACGACGUCUU | 212 | GACGUCGUCGUUCCAGCGGUU | 1715 |
| D-1208 | 1187-1205 | 1070-1088 | CGCUGGAACGACGACGUCUUU | 213 | AGACGUCGUCGUUCCAGCGUU | 1716 |
| D-1209 | 1188-1206 | 1071-1089 | GCUGGAACGACGACGUCUGUU | 214 | CAGACGUCGUCGUUCCAGCUU | 1717 |
| D-1210 | 1189-1207 | 1072-1090 | CUGGAACGACGACGUCUGCUU | 215 | GCAGACGUCGUCGUUCCAGUU | 1718 |
| D-1211 | 1-19 | 1-19 | CCCAAACGGUGCACGGAAGUU | 216 | CUUCCGUGCACCGUUUGGGUU | 1719 |
| D-1212 | 1190-1208 | 1073-1091 | UGGAACGACGACGUCUGCCUU | 217 | GGCAGACGUCGUCGUUCCAUU | 1720 |
| D-1213 | 1191-1209 | 1074-1092 | GGAACGACGACGUCUGCCAUU | 218 | UGGCAGACGUCGUCGUUCCUU | 1721 |
| D-1214 | 119-137 | 119-137 | GUUCCAAUCCAUUUCCACCUU | 219 | GGUGGAAAUGGAUUGGAACUU | 1722 |
| D-1215 | 1192-1210 | 1075-1093 | GAACGACGACGUCUGCCAGUU | 220 | CUGGCAGACGUCGUCGUUCUU | 1723 |
| D-1216 | 1193-1211 | 1076-1094 | AACGACGACGUCUGCCAGAUU | 221 | UCUGGCAGACGUCGUCGUUUU | 1724 |
| D-1217 | 1194-1212 | 1077-1095 | ACGACGACGUCUGCCAGAGUU | 222 | CUCUGGCAGACGUCGUCGUUU | 1725 |
| D-1218 | 1195-1213 | 1078-1096 | CGACGACGUCUGCCAGAGGUU | 223 | CCUCUGGCAGACGUCGUCGUU | 1726 |
| D-1219 | 1196-1214 | 1079-1097 | GACGACGUCUGCCAGAGGCUU | 224 | GCCUCUGGCAGACGUCGUCUU | 1727 |
| D-1220 | 1197-1215 | 1080-1098 | ACGACGUCUGCCAGAGGCCUU | 225 | GGCCUCUGGCAGACGUCGUUU | 1728 |
| D-1221 | 1198-1216 | 1081-1099 | CGACGUCUGCCAGAGGCCCUU | 226 | GGGCCUCUGGCAGACGUCGUU | 1729 |
| D-1222 | 1199-1217 | 1082-1100 | GACGUCUGCCAGAGGCCCUUU | 227 | AGGGCCUCUGGCAGACGUCUU | 1730 |
| D-1223 | 1200-1218 | 1083-1101 | ACGUCUGCCAGAGGCCCUAUU | 228 | UAGGGCCUCUGGCAGACGUUU | 1731 |
| D-1224 | 1201-1219 | 1084-1102 | CGUCUGCCAGAGGCCCUACUU | 229 | GUAGGGCCUCUGGCAGACGUU | 1732 |
| D-1225 | 120-138 | 120-138 | UUCCAAUCCAUUUCCACCUUU | 230 | AGGUGGAAAUGGAUUGGAAUU | 1733 |
| D-1226 | 1202-1220 | 1085-1103 | GUCUGCCAGAGGCCCUACCUU | 231 | GGUAGGGCCUCUGGCAGACUU | 1734 |
| D-1227 | 1203-1221 | 1086-1104 | UCUGCCAGAGGCCCUACCGUU | 232 | CGGUAGGGCCUCUGGCAGAUU | 1735 |
| D-1228 | 1204-1222 | 1087-1105 | CUGCCAGAGGCCCUACCGCUU | 233 | GCGGUAGGGCCUCUGGCAGUU | 1736 |
| D-1229 | 1205-1223 | 1088-1106 | UGCCAGAGGCCCUACCGCUUU | 234 | AGCGGUAGGGCCUCUGGCAUU | 1737 |
| D-1230 | 1206-1224 | 1089-1107 | GCCAGAGGCCCUACCGCUGUU | 235 | CAGCGGUAGGGCCUCUGGCUU | 1738 |
| D-1231 | 1207-1225 | 1090-1108 | CCAGAGGCCCUACCGCUGGUU | 236 | CCAGCGGUAGGGCCUCUGGUU | 1739 |
| D-1232 | 1208-1226 | 1091-1109 | CAGAGGCCCUACCGCUGGGUU | 237 | CCCAGCGGUAGGGCCUCUGUU | 1740 |
| D-1233 | 1209-1227 | 1092-1110 | AGAGGCCCUACCGCUGGGUUU | 238 | ACCCAGCGGUAGGGCCUCUUU | 1741 |
| D-1234 | 1210-1228 | 1093-1111 | GAGGCCCUACCGCUGGGUCUU | 239 | GACCCAGCGGUAGGGCCUCUU | 1742 |
| D-1235 | 1211-1229 | 1094-1112 | AGGCCCUACCGCUGGGUCUUU | 240 | AGACCCAGCGGUAGGGCCUUU | 1743 |
| D-1236 | 121-139 | 121-139 | UCCAAUCCAUUUCCACCUCUU | 241 | GAGGUGGAAAUGGAUUGGAUU | 1744 |
| D-1237 | 1212-1230 | 1095-1113 | GGCCCUACCGCUGGGUCUGUU | 242 | CAGACCCAGCGGUAGGGCCUU | 1745 |
| D-1238 | 1213-1231 | 1096-1114 | GCCCUACCGCUGGGUCUGCUU | 243 | GCAGACCCAGCGGUAGGGCUU | 1746 |
| D-1239 | 1214-1232 | 1097-1115 | CCCUACCGCUGGGUCUGCGUU | 244 | CGCAGACCCAGCGGUAGGGUU | 1747 |
| D-1240 | 1215-1233 | 1098-1116 | CCUACCGCUGGGUCUGCGAUU | 245 | UCGCAGACCCAGCGGUAGGUU | 1748 |
| D-1241 | 1216-1234 | 1099-1117 | CUACCGCUGGGUCUGCGAGUU | 246 | CUCGCAGACCCAGCGGUAGUU | 1749 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1242 | 1217-1235 | 1100-1118 | UACCGCUGGGUCUGCGAGAUU | 247 | UCUCGCAGACCCAGCGGUAUU | 1750 |
| D-1243 | 1218-1236 | 1101-1119 | ACCGCUGGGUCUGCGAGACUU | 248 | GUCUCGCAGACCCAGCGGUUU | 1751 |
| D-1244 | 1219-1237 | 1102-1120 | CCGCUGGGUCUGCGAGACAUU | 249 | UGUCUCGCAGACCCAGCGGUU | 1752 |
| D-1245 | 1220-1238 | 1103-1121 | CGCUGGGUCUGCGAGACAGUU | 250 | CUGUCUCGCAGACCCAGCGUU | 1753 |
| D-1246 | 1221-1239 | 1104-1122 | GCUGGGUCUGCGAGACAGAUU | 251 | UCUGUCUCGCAGACCCAGCUU | 1754 |
| D-1247 | 122-140 | 122-140 | CCAAUCCAUUUCCACCUCUUU | 252 | AGAGGUGGAAAUGGAUUGGUU | 1755 |
| D-1248 | 1222-1240 | 1105-1123 | CUGGGUCUGCGAGACAGAGUU | 253 | CUCUGUCUCGCAGACCCAGUU | 1756 |
| D-1249 | 1223-1241 | 1106-1124 | UGGGUCUGCGAGACAGAGCUU | 254 | GCUCUGUCUCGCAGACCCAUU | 1757 |
| D-1250 | 1224-1242 | 1107-1125 | GGGUCUGCGAGACAGAGCUUU | 255 | AGCUCUGUCUCGCAGACCCUU | 1758 |
| D-1251 | 1225-1243 | 1108-1126 | GGUCUGCGAGACAGAGCUGUU | 256 | CAGCUCUGUCUCGCAGACCUU | 1759 |
| D-1252 | 1226-1244 | 1109-1127 | GUCUGCGAGACAGAGCUGGUU | 257 | CCAGCUCUGUCUCGCAGACUU | 1760 |
| D-1253 | 1227-1245 | 1110-1128 | UCUGCGAGACAGAGCUGGAUU | 258 | UCCAGCUCUGUCUCGCAGAUU | 1761 |
| D-1254 | 1228-1246 | 1111-1129 | CUGCGAGACAGAGCUGGACUU | 259 | GUCCAGCUCUGUCUCGCAGUU | 1762 |
| D-1255 | 1229-1247 | 1112-1130 | UGCGAGACAGAGCUGGACAUU | 260 | UGUCCAGCUCUGUCUCGCAUU | 1763 |
| D-1256 | 12-30 | 12-30 | CACGGAAGAGUGAGGUGACUU | 261 | GUCACCUCACUCUUCCGUGUU | 1764 |
| D-1257 | 1230-1248 | 1113-1131 | GCGAGACAGAGCUGGACAAUU | 262 | UUGUCCAGCUCUGUCUCGCUU | 1765 |
| D-1258 | 1231-1249 | 1114-1132 | CGAGACAGAGCUGGACAAGUU | 263 | CUUGUCCAGCUCUGUCUCGUU | 1766 |
| D-1259 | 123-141 | 123-141 | CAAUCCAUUUCCACCUCUGUU | 264 | CAGAGGUGGAAAUGGAUUGUU | 1767 |
| D-1260 | 1232-1250 | 1115-1133 | GAGACAGAGCUGGACAAGGUU | 265 | CCUUGUCCAGCUCUGUCUCUU | 1768 |
| D-1261 | 1233-1251 | 1116-1134 | AGACAGAGCUGGACAAGGCUU | 266 | GCCUUGUCCAGCUCUGUCUUU | 1769 |
| D-1262 | 1234-1252 | 1117-1135 | GACAGAGCUGGACAAGGCCUU | 267 | GGCCUUGUCCAGCUCUGUCUU | 1770 |
| D-1263 | 1235-1253 | 1118-1136 | ACAGAGCUGGACAAGGCCAUU | 268 | UGGCCUUGUCCAGCUCUGUUU | 1771 |
| D-1264 | 1236-1254 | 1119-1137 | CAGAGCUGGACAAGGCCAGUU | 269 | CUGGCCUUGUCCAGCUCUGUU | 1772 |
| D-1265 | 1237-1255 | 1120-1138 | AGAGCUGGACAAGGCCAGCUU | 270 | GCUGGCCUUGUCCAGCUCUUU | 1773 |
| D-1266 | 1238-1256 | 1121-1139 | GAGCUGGACAAGGCCAGCCUU | 271 | GGCUGGCCUUGUCCAGCUCUU | 1774 |
| D-1267 | 1239-1257 | 1122-1140 | AGCUGGACAAGGCCAGCCAUU | 272 | UGGCUGGCCUUGUCCAGCUUU | 1775 |
| D-1268 | 1240-1258 | 1123-1141 | GCUGGACAAGGCCAGCCAGUU | 273 | CUGGCUGGCCUUGUCCAGCUU | 1776 |
| D-1269 | 1241-1259 | 1124-1142 | CUGGACAAGGCCAGCCAGGUU | 274 | CCUGGCUGGCCUUGUCCAGUU | 1777 |
| D-1270 | 124-142 | 124-142 | AAUCCAUUUCCACCUCUGUUU | 275 | ACAGAGGUGGAAAUGGAUUUU | 1778 |
| D-1271 | 1242-1260 | 1125-1143 | UGGACAAGGCCAGCCAGGAUU | 276 | UCCUGGCUGGCCUUGUCCAUU | 1779 |
| D-1272 | 1243-1261 | 1126-1144 | GGACAAGGCCAGCCAGGAGUU | 277 | CUCCUGGCUGGCCUUGUCCUU | 1780 |
| D-1273 | 1244-1262 | 1127-1145 | GACAAGGCCAGCCAGGAGCUU | 278 | GCUCCUGGCUGGCCUUGUCUU | 1781 |
| D-1274 | 1245-1263 | 1128-1146 | ACAAGGCCAGCCAGGAGCCUU | 279 | GGCUCCUGGCUGGCCUUGUUU | 1782 |
| D-1275 | 1246-1264 | 1129-1147 | CAAGGCCAGCCAGGAGCCAUU | 280 | UGGCUCCUGGCUGGCCUUGUU | 1783 |
| D-1276 | 1247-1265 | 1130-1148 | AAGGCCAGCCAGGAGCCACUU | 281 | GUGGCUCCUGGCUGGCCUUUU | 1784 |
| D-1277 | 1248-1266 | 1131-1149 | AGGCCAGCCAGGAGCCACCUU | 282 | GGUGGCUCCUGGCUGGCCUUU | 1785 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1278 | 1249-1267 | 1132-1150 | GGCCAGCCAGGAGCCACCUUU | 283 | AGGUGGCUCCUGGCUGGCCUU | 1786 |
| D-1279 | 1250-1268 | 1133-1151 | GCCAGCCAGGAGCCACCUCUU | 284 | GAGGUGGCUCCUGGCUGGCUU | 1787 |
| D-1280 | 1251-1269 | 1134-1152 | CCAGCCAGGAGCCACCUCUUU | 285 | AGAGGUGGCUCCUGGCUGGUU | 1788 |
| D-1281 | 125-143 | 125-143 | AUCCAUUUCCACCUCUGUUUU | 286 | AACAGAGGUGGAAAUGGAUUU | 1789 |
| D-1282 | 1252-1270 | 1135-1153 | CAGCCAGGAGCCACCUCUCUU | 287 | GAGAGGUGGCUCCUGGCUGUU | 1790 |
| D-1283 | 1253-1271 | 1136-1154 | AGCCAGGAGCCACCUCUCCUU | 288 | GGAGAGGUGGCUCCUGGCUUU | 1791 |
| D-1284 | 1254-1272 | 1137-1155 | GCCAGGAGCCACCUCUCCUUU | 289 | AGGAGAGGUGGCUCCUGGCUU | 1792 |
| D-1285 | 1255-1273 | 1138-1156 | CCAGGAGCCACCUCUCCUUUU | 290 | AAGGAGAGGUGGCUCCUGGUU | 1793 |
| D-1286 | 1256-1274 | 1139-1157 | CAGGAGCCACCUCUCCUUUUU | 291 | AAAGGAGAGGUGGCUCCUGUU | 1794 |
| D-1287 | 1257-1275 | 1140-1158 | AGGAGCCACCUCUCCUUUAUU | 292 | UAAAGGAGAGGUGGCUCCUUU | 1795 |
| D-1288 | 1258-1276 | 1141-1159 | GGAGCCACCUCUCCUUUAAUU | 293 | UUAAAGGAGAGGUGGCUCCUU | 1796 |
| D-1289 | 1259-1277 | 1142-1160 | GAGCCACCUCUCCUUUAAUUU | 294 | AUUAAAGGAGAGGUGGCUCUU | 1797 |
| D-1290 | 1260-1278 | 1143-1161 | AGCCACCUCUCCUUUAAUUUU | 295 | AAUUAAAGGAGAGGUGGCUUU | 1798 |
| D-1291 | 1261-1279 | 1144-1162 | GCCACCUCUCCUUUAAUUUUU | 296 | AAAUUAAAGGAGAGGUGGCUU | 1799 |
| D-1292 | 126-144 | 126-144 | UCCAUUUCCACCUCUGUUUUU | 297 | AAACAGAGGUGGAAAUGGAUU | 1800 |
| D-1293 | 1262-1280 | 1145-1163 | CCACCUCUCCUUUAAUUUAUU | 298 | UAAAUUAAAGGAGAGGUGGUU | 1801 |
| D-1294 | 1263-1281 | 1146-1164 | CACCUCUCCUUUAAUUUAUUU | 299 | AUAAAUUAAAGGAGAGGUGUU | 1802 |
| D-1295 | 1264-1282 | 1147-1165 | ACCUCUCCUUUAAUUUAUUUU | 300 | AAUAAAUUAAAGGAGAGGUUU | 1803 |
| D-1296 | 1265-1283 | 1148-1166 | CCUCUCCUUUAAUUUAUUUUU | 301 | AAAUAAAUUAAAGGAGAGGUU | 1804 |
| D-1297 | 1266-1284 | 1149-1167 | CUCUCCUUUAAUUUAUUUCUU | 302 | GAAAUAAAUUAAAGGAGAGUU | 1805 |
| D-1298 | 1267-1285 | 1150-1168 | UCUCCUUUAAUUUAUUUCUUU | 303 | AGAAAUAAAUUAAAGGAGAUU | 1806 |
| D-1299 | 1268-1286 | 1151-1169 | CUCCUUUAAUUUAUUUCUUUU | 304 | AAGAAAUAAAUUAAAGGAGUU | 1807 |
| D-1300 | 1269-1287 | 1152-1170 | UCCUUUAAUUUAUUUCUUCUU | 305 | GAAGAAAUAAAUUAAAGGAUU | 1808 |
| D-1301 | 1270-1288 | 1153-1171 | CCUUUAAUUUAUUUCUUCAUU | 306 | UGAAGAAAUAAAUUAAAGGUU | 1809 |
| D-1302 | 1271-1289 | 1154-1172 | CUUUAAUUUAUUUCUUCAAUU | 307 | UUGAAGAAAUAAAUUAAAGUU | 1810 |
| D-1303 | 127-145 | 127-145 | CCAUUUCCACCUCUGUUUAUU | 308 | UAAACAGAGGUGGAAAUGGUU | 1811 |
| D-1304 | 1272-1290 | 1155-1173 | UUUAAUUUAUUUCUUCAAUUU | 309 | AUUGAAGAAAUAAAUUAAAUU | 1812 |
| D-1305 | 1273-1291 | 1156-1174 | UUAAUUUAUUUCUUCAAUGUU | 310 | CAUUGAAGAAAUAAAUUAAUU | 1813 |
| D-1306 | 1274-1292 | 1157-1175 | UAAUUUAUUUCUUCAAUGCUU | 311 | GCAUUGAAGAAAUAAAUUAUU | 1814 |
| D-1307 | 1275-1293 | 1158-1176 | AAUUUAUUUCUUCAAUGCCUU | 312 | GGCAUUGAAGAAAUAAAUUUU | 1815 |
| D-1308 | 1276-1294 | 1159-1177 | AUUUAUUUCUUCAAUGCCUUU | 313 | AGGCAUUGAAGAAAUAAAUUU | 1816 |
| D-1309 | 1277-1295 | 1160-1178 | UUUAUUUCUUCAAUGCCUCUU | 314 | GAGGCAUUGAAGAAAUAAAUU | 1817 |
| D-1310 | 1278-1296 | 1161-1179 | UUAUUUCUUCAAUGCCUCGUU | 315 | CGAGGCAUUGAAGAAAUAAUU | 1818 |
| D-1311 | 1279-1297 | 1162-1180 | UAUUUCUUCAAUGCCUCGAUU | 316 | UCGAGGCAUUGAAGAAAUAUU | 1819 |
| D-1312 | 1280-1298 | 1163-1181 | AUUUCUUCAAUGCCUCGACUU | 317 | GUCGAGGCAUUGAAGAAAUUU | 1820 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1313 | 1281-1299 | 1164-1182 | UUUCUUCAAUGCCUCGACCUU | 318 | GGUCGAGGCAUUGAAGAAAUU | 1821 |
| D-1314 | 128-146 | 128-146 | CAUUUCCACCUCUGUUUACUU | 319 | GUAAACAGAGGUGGAAAUGUU | 1822 |
| D-1315 | 1282-1300 | 1165-1183 | UUCUUCAAUGCCUCGACCUUU | 320 | AGGUCGAGGCAUUGAAGAAUU | 1823 |
| D-1316 | 1283-1301 | 1166-1184 | UCUUCAAUGCCUCGACCUGUU | 321 | CAGGUCGAGGCAUUGAAGAUU | 1824 |
| D-1317 | 1284-1302 | 1167-1185 | CUUCAAUGCCUCGACCUGCUU | 322 | GCAGGUCGAGGCAUUGAAGUU | 1825 |
| D-1318 | 1285-1303 | 1168-1186 | UUCAAUGCCUCGACCUGCCUU | 323 | GGCAGGUCGAGGCAUUGAAUU | 1826 |
| D-1319 | 1286-1304 | 1169-1187 | UCAAUGCCUCGACCUGCCGUU | 324 | CGGCAGGUCGAGGCAUUGAUU | 1827 |
| D-1320 | 1287-1305 | 1170-1188 | CAAUGCCUCGACCUGCCGCUU | 325 | GCGGCAGGUCGAGGCAUUGUU | 1828 |
| D-1321 | 1288-1306 | 1171-1189 | AAUGCCUCGACCUGCCGCAUU | 326 | UGCGGCAGGUCGAGGCAUUUU | 1829 |
| D-1322 | 1289-1307 | 1172-1190 | AUGCCUCGACCUGCCGCAGUU | 327 | CUGCGGCAGGUCGAGGCAUUU | 1830 |
| D-1323 | 1290-1308 | 1173-1191 | UGCCUCGACCUGCCGCAGGUU | 328 | CCUGCGGCAGGUCGAGGCAUU | 1831 |
| D-1324 | 1291-1309 | 1174-1192 | GCCUCGACCUGCCGCAGGGUU | 329 | CCCUGCGGCAGGUCGAGGCUU | 1832 |
| D-1325 | 129-147 | 129-147 | AUUUCCACCUCUGUUUACUUU | 330 | AGUAAACAGAGGUGGAAAUUU | 1833 |
| D-1326 | 1292-1310 | 1175-1193 | CCUCGACCUGCCGCAGGGGUU | 331 | CCCCUGCGGCAGGUCGAGGUU | 1834 |
| D-1327 | 1293-1311 | 1176-1194 | CUCGACCUGCCGCAGGGGUUU | 332 | ACCCCUGCGGCAGGUCGAGUU | 1835 |
| D-1328 | 1294-1312 | 1177-1195 | UCGACCUGCCGCAGGGGUCUU | 333 | GACCCCUGCGGCAGGUCGAUU | 1836 |
| D-1329 | 1295-1313 | 1178-1196 | CGACCUGCCGCAGGGGUCCUU | 334 | GGACCCCUGCGGCAGGUCGUU | 1837 |
| D-1330 | 1296-1314 | 1179-1197 | GACCUGCCGCAGGGGUCCGUU | 335 | CGGACCCCUGCGGCAGGUCUU | 1838 |
| D-1331 | 1297-1315 | 1180-1198 | ACCUGCCGCAGGGGUCCGGUU | 336 | CCGGACCCCUGCGGCAGGUUU | 1839 |
| D-1332 | 1298-1316 | 1181-1199 | CCUGCCGCAGGGGUCCGGGUU | 337 | CCCGGACCCCUGCGGCAGGUU | 1840 |
| D-1333 | 1299-1317 | 1182-1200 | CUGCCGCAGGGGUCCGGGAUU | 338 | UCCCGGACCCCUGCGGCAGUU | 1841 |
| D-1334 | 1300-1318 | 1183-1201 | UGCCGCAGGGGUCCGGGAUUU | 339 | AUCCCGGACCCCUGCGGCAUU | 1842 |
| D-1335 | 1301-1319 | 1184-1202 | GCCGCAGGGGUCCGGGAUUUU | 340 | AAUCCCGGACCCCUGCGGCUU | 1843 |
| D-1336 | 130-148 | 130-148 | UUUCCACCUCUGUUUACUGUU | 341 | CAGUAAACAGAGGUGGAAAUU | 1844 |
| D-1337 | 1302-1320 | 1185-1203 | CCGCAGGGGUCCGGGAUUGUU | 342 | CAAUCCCGGACCCCUGCGGUU | 1845 |
| D-1338 | 1303-1321 | 1186-1204 | CGCAGGGGUCCGGGAUUGGUU | 343 | CCAAUCCCGGACCCCUGCGUU | 1846 |
| D-1339 | 1304-1322 | 1187-1205 | GCAGGGGUCCGGGAUUGGGUU | 344 | CCCAAUCCCGGACCCCUGCUU | 1847 |
| D-1340 | 1305-1323 | 1188-1206 | CAGGGGUCCGGGAUUGGGAUU | 345 | UCCCAAUCCCGGACCCCUGUU | 1848 |
| D-1341 | 1306-1324 | 1189-1207 | AGGGGUCCGGGAUUGGGAAUU | 346 | UUCCCAAUCCCGGACCCCUUU | 1849 |
| D-1342 | 1307-1325 | 1190-1208 | GGGGUCCGGGAUUGGGAAUUU | 347 | AUUCCCAAUCCCGGACCCCUU | 1850 |
| D-1343 | 1308-1326 | 1191-1209 | GGGUCCGGGAUUGGGAAUCUU | 348 | GAUUCCCAAUCCCGGACCCUU | 1851 |
| D-1344 | 1309-1327 | 1192-1210 | GGUCCGGGAUUGGGAAUCCUU | 349 | GGAUUCCCAAUCCCGGACCUU | 1852 |
| D-1345 | 1310-1328 | 1193-1211 | GUCCGGGAUUGGGAAUCCGUU | 350 | CGGAUUCCCAAUCCCGGACUU | 1853 |
| D-1346 | 1311-1329 | 1194-1212 | UCCGGGAUUGGGAAUCCGCUU | 351 | GCGGAUUCCCAAUCCCGGAUU | 1854 |
| D-1347 | 131-149 | 131-149 | UUCCACCUCUGUUUACUGUUU | 352 | ACAGUAAACAGAGGUGGAAUU | 1855 |
| D-1348 | 1312-1330 | 1195-1213 | CCGGGAUUGGGAAUCCGCCUU | 353 | GGCGGAUUCCCAAUCCCGGUU | 1856 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1349 | 1313-1331 | 1196-1214 | CGGGAUUGGGAAUCCGCCCUU | 354 | GGGCGGAUUCCCAAUCCCGUU | 1857 |
| D-1350 | 1314-1332 | 1197-1215 | GGGAUUGGGAAUCCGCCCAUU | 355 | UGGGCGGAUUCCCAAUCCCUU | 1858 |
| D-1351 | 1315-1333 | 1198-1216 | GGAUUGGGAAUCCGCCCAUUU | 356 | AUGGGCGGAUUCCCAAUCCUU | 1859 |
| D-1352 | 1316-1334 | 1199-1217 | GAUUGGGAAUCCGCCCAUCUU | 357 | GAUGGGCGGAUUCCCAAUCUU | 1860 |
| D-1353 | 1317-1335 | 1200-1218 | AUUGGGAAUCCGCCCAUCUUU | 358 | AGAUGGGCGGAUUCCCAAUUU | 1861 |
| D-1354 | 1318-1336 | 1201-1219 | UUGGGAAUCCGCCCAUCUGUU | 359 | CAGAUGGGCGGAUUCCCAAUU | 1862 |
| D-1355 | 1319-1337 | 1202-1220 | UGGGAAUCCGCCCAUCUGGUU | 360 | CCAGAUGGGCGGAUUCCCAUU | 1863 |
| D-1356 | 1320-1338 | 1203-1221 | GGGAAUCCGCCCAUCUGGGUU | 361 | CCCAGAUGGGCGGAUUCCCUU | 1864 |
| D-1357 | 1321-1339 | 1204-1222 | GGAAUCCGCCCAUCUGGGGUU | 362 | CCCCAGAUGGGCGGAUUCCUU | 1865 |
| D-1358 | 132-150 | 132-150 | UCCACCUCUGUUUACUGUCUU | 363 | GACAGUAAACAGAGGUGGAUU | 1866 |
| D-1359 | 1322-1340 | 1205-1223 | GAAUCCGCCCAUCUGGGGGUU | 364 | CCCCCAGAUGGGCGGAUUCUU | 1867 |
| D-1360 | 1323-1341 | 1206-1224 | AAUCCGCCCAUCUGGGGGCUU | 365 | GCCCCCAGAUGGGCGGAUUUU | 1868 |
| D-1361 | 1324-1342 | 1207-1225 | AUCCGCCCAUCUGGGGGCCUU | 366 | GGCCCCCAGAUGGGCGGAUUU | 1869 |
| D-1362 | 1325-1343 | 1208-1226 | UCCGCCCAUCUGGGGGCCUUU | 367 | AGGCCCCCAGAUGGGCGGAUU | 1870 |
| D-1363 | 1326-1344 | 1209-1227 | CCGCCCAUCUGGGGGCCUCUU | 368 | GAGGCCCCCAGAUGGGCGGUU | 1871 |
| D-1364 | 1327-1345 | 1210-1228 | CGCCCAUCUGGGGGCCUCUUU | 369 | AGAGGCCCCCAGAUGGGCGUU | 1872 |
| D-1365 | 1328-1346 | 1211-1229 | GCCCAUCUGGGGGCCUCUUUU | 370 | AAGAGGCCCCCAGAUGGGCUU | 1873 |
| D-1366 | 1329-1347 | 1212-1230 | CCCAUCUGGGGGCCUCUUCUU | 371 | GAAGAGGCCCCCAGAUGGGUU | 1874 |
| D-1367 | 1330-1348 | 1213-1231 | CCAUCUGGGGGCCUCUUCUUU | 372 | AGAAGAGGCCCCCAGAUGGUU | 1875 |
| D-1368 | 13-31 | 13-31 | ACGGAAGAGUGAGGUGACUUU | 373 | AGUCACCUCACUCUUCCGUUU | 1876 |
| D-1369 | 1331-1349 | 1214-1232 | CAUCUGGGGGCCUCUUCUGUU | 374 | CAGAAGAGGCCCCCAGAUGUU | 1877 |
| D-1370 | 133-151 | 133-151 | CCACCUCUGUUUACUGUCCUU | 375 | GGACAGUAAACAGAGGUGGUU | 1878 |
| D-1371 | 1332-1350 | 1215-1233 | AUCUGGGGGCCUCUUCUGCUU | 376 | GCAGAAGAGGCCCCCAGAUUU | 1879 |
| D-1372 | 1333-1351 | 1216-1234 | UCUGGGGGCCUCUUCUGCUUU | 377 | AGCAGAAGAGGCCCCCAGAUU | 1880 |
| D-1373 | 1334-1352 | 1217-1235 | CUGGGGGCCUCUUCUGCUUUU | 378 | AAGCAGAAGAGGCCCCCAGUU | 1881 |
| D-1374 | 1335-1353 | 1218-1236 | UGGGGGCCUCUUCUGCUUUUU | 379 | AAAGCAGAAGAGGCCCCCAUU | 1882 |
| D-1375 | 1336-1354 | 1219-1237 | GGGGGCCUCUUCUGCUUUCUU | 380 | GAAAGCAGAAGAGGCCCCCUU | 1883 |
| D-1376 | 1337-1355 | 1220-1238 | GGGGCCUCUUCUGCUUUCUUU | 381 | AGAAAGCAGAAGAGGCCCCUU | 1884 |
| D-1377 | 1338-1356 | 1221-1239 | GGGCCUCUUCUGCUUUCUCUU | 382 | GAGAAAGCAGAAGAGGCCCUU | 1885 |
| D-1378 | 1339-1357 | 1222-1240 | GGCCUCUUCUGCUUUCUCGUU | 383 | CGAGAAAGCAGAAGAGGCCUU | 1886 |
| D-1379 | 1340-1358 | 1223-1241 | GCCUCUUCUGCUUUCUCGGUU | 384 | CCGAGAAAGCAGAAGAGGCUU | 1887 |
| D-1380 | 1341-1359 | 1224-1242 | CCUCUUCUGCUUUCUCGGGUU | 385 | CCCGAGAAAGCAGAAGAGGUU | 1888 |
| D-1381 | 134-152 | 134-152 | CACCUCUGUUUACUGUCCAUU | 386 | UGGACAGUAAACAGAGGUGUU | 1889 |
| D-1382 | 1342-1360 | 1225-1243 | CUCUUCUGCUUUCUCGGGAUU | 387 | UCCCGAGAAAGCAGAAGAGUU | 1890 |
| D-1383 | 1343-1361 | 1226-1244 | UCUUCUGCUUUCUCGGGAAUU | 388 | UUCCCGAGAAAGCAGAAGAUU | 1891 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1384 | 1344-1362 | 1227-1245 | CUUCUGCUUUCUCGGGAAUUU | 389 | AUUCCCGAGAAAGCAGAAGUU | 1892 |
| D-1385 | 1345-1363 | 1228-1246 | UUCUGCUUUCUCGGGAAUUUU | 390 | AAUUCCCGAGAAAGCAGAAUU | 1893 |
| D-1386 | 1346-1364 | 1229-1247 | UCUGCUUUCUCGGGAAUUUUU | 391 | AAAUUCCCGAGAAAGCAGAUU | 1894 |
| D-1387 | 1347-1365 | 1230-1248 | CUGCUUUCUCGGGAAUUUUUU | 392 | AAAAUUCCCGAGAAAGCAGUU | 1895 |
| D-1388 | 1348-1366 | 1231-1249 | UGCUUUCUCGGGAAUUUUCUU | 393 | GAAAAUUCCCGAGAAAGCAUU | 1896 |
| D-1389 | 1349-1367 | 1232-1250 | GCUUUCUCGGGAAUUUUCAUU | 394 | UGAAAAUUCCCGAGAAAGCUU | 1897 |
| D-1390 | 1350-1368 | 1233-1251 | CUUUCUCGGGAAUUUUCAUUU | 395 | AUGAAAAUUCCCGAGAAAGUU | 1898 |
| D-1391 | 1351-1369 | 1234-1252 | UUUCUCGGGAAUUUUCAUCUU | 396 | GAUGAAAAUUCCCGAGAAAUU | 1899 |
| D-1392 | 135-153 | 135-153 | ACCUCUGUUUACUGUCCAAUU | 397 | UUGGACAGUAAACAGAGGUUU | 1900 |
| D-1393 | 1352-1370 | 1235-1253 | UUCUCGGGAAUUUUCAUCUUU | 398 | AGAUGAAAAUUCCCGAGAAUU | 1901 |
| D-1394 | 1353-1371 | 1236-1254 | UCUCGGGAAUUUUCAUCUAUU | 399 | UAGAUGAAAAUUCCCGAGAUU | 1902 |
| D-1395 | 1354-1372 | 1237-1255 | CUCGGGAAUUUUCAUCUAGUU | 400 | CUAGAUGAAAAUUCCCGAGUU | 1903 |
| D-1396 | 1355-1373 | 1238-1256 | UCGGGAAUUUUCAUCUAGGUU | 401 | CCUAGAUGAAAAUUCCCGAUU | 1904 |
| D-1397 | 1356-1374 | 1239-1257 | CGGGAAUUUUCAUCUAGGAUU | 402 | UCCUAGAUGAAAAUUCCCGUU | 1905 |
| D-1398 | 1357-1375 | 1240-1258 | GGGAAUUUUCAUCUAGGAUUU | 403 | AUCCUAGAUGAAAAUUCCCUU | 1906 |
| D-1399 | 1358-1376 | 1241-1259 | GGAAUUUUCAUCUAGGAUUUU | 404 | AAUCCUAGAUGAAAAUUCCUU | 1907 |
| D-1400 | 1359-1377 | 1242-1260 | GAAUUUUCAUCUAGGAUUUUU | 405 | AAAUCCUAGAUGAAAAUUCUU | 1908 |
| D-1401 | 1360-1378 | 1243-1261 | AAUUUUCAUCUAGGAUUUUUU | 406 | AAAAUCCUAGAUGAAAAUUUU | 1909 |
| D-1402 | 1361-1379 | 1244-1262 | AUUUUCAUCUAGGAUUUUAUU | 407 | UAAAAUCCUAGAUGAAAAUUU | 1910 |
| D-1403 | 136-154 | 136-154 | CCUCUGUUUACUGUCCAAAUU | 408 | UUUGGACAGUAAACAGAGGUU | 1911 |
| D-1404 | 1362-1380 | 1245-1263 | UUUUCAUCUAGGAUUUUAAUU | 409 | UUAAAAUCCUAGAUGAAAAUU | 1912 |
| D-1405 | 1363-1381 | 1246-1264 | UUUCAUCUAGGAUUUUAAGUU | 410 | CUUAAAAUCCUAGAUGAAAUU | 1913 |
| D-1406 | 1364-1382 | 1247-1265 | UUCAUCUAGGAUUUUAAGGUU | 411 | CCUUAAAAUCCUAGAUGAAUU | 1914 |
| D-1407 | 1365-1383 | 1248-1266 | UCAUCUAGGAUUUUAAGGGUU | 412 | CCCUUAAAAUCCUAGAUGAUU | 1915 |
| D-1408 | 1366-1384 | 1249-1267 | CAUCUAGGAUUUUAAGGGAUU | 413 | UCCCUUAAAAUCCUAGAUGUU | 1916 |
| D-1409 | 1367-1385 | 1250-1268 | AUCUAGGAUUUUAAGGGAAUU | 414 | UUCCCUUAAAAUCCUAGAUUU | 1917 |
| D-1410 | 1368-1386 | 1251-1269 | UCUAGGAUUUUAAGGGAAGUU | 415 | CUUCCCUUAAAAUCCUAGAUU | 1918 |
| D-1411 | 1369-1387 | 1252-1270 | CUAGGAUUUUAAGGGAAGGUU | 416 | CCUUCCCUUAAAAUCCUAGUU | 1919 |
| D-1412 | 1370-1388 | 1253-1271 | UAGGAUUUUAAGGGAAGGGUU | 417 | CCCUUCCCUUAAAAUCCUAUU | 1920 |
| D-1413 | 1371-1389 | 1254-1272 | AGGAUUUUAAGGGAAGGGGUU | 418 | CCCCUUCCCUUAAAAUCCUUU | 1921 |
| D-1414 | 137-155 | 137-155 | CUCUGUUUACUGUCCAAAGUU | 419 | CUUUGGACAGUAAACAGAGUU | 1922 |
| D-1415 | 1372-1390 | 1255-1273 | GGAUUUUAAGGGAAGGGGAUU | 420 | UCCCCUUCCCUUAAAAUCCUU | 1923 |
| D-1416 | 1373-1391 | 1256-1274 | GAUUUUAAGGGAAGGGGAAUU | 421 | UUCCCCUUCCCUUAAAAUCUU | 1924 |
| D-1417 | 1374-1392 | 1257-1275 | AUUUUAAGGGAAGGGGAAGUU | 422 | CUUCCCCUUCCCUUAAAAUUU | 1925 |
| D-1418 | 1375-1393 | 1258-1276 | UUUUAAGGGAAGGGGAAGGUU | 423 | CCUUCCCCUUCCCUUAAAAUU | 1926 |
| D-1419 | 1376-1394 | 1259-1277 | UUUAAGGGAAGGGGAAGGAUU | 424 | UCCUUCCCCUUCCCUUAAAUU | 1927 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1420 | 1377-1395 | 1260-1278 | UUAAGGGAAGGGGAAGGAUUU | 425 | AUCCUUCCCCUUCCCUUAAUU | 1928 |
| D-1421 | 1378-1396 | 1261-1279 | UAAGGGAAGGGGAAGGAUAUU | 426 | UAUCCUUCCCCUUCCCUUAUU | 1929 |
| D-1422 | 1379-1397 | 1262-1280 | AAGGGAAGGGGAAGGAUAGUU | 427 | CUAUCCUUCCCCUUCCCUUUU | 1930 |
| D-1423 | 1380-1398 | 1263-1281 | AGGGAAGGGGAAGGAUAGGUU | 428 | CCUAUCCUUCCCCUUCCCUUU | 1931 |
| D-1424 | 1381-1399 | 1264-1282 | GGGAAGGGGAAGGAUAGGGUU | 429 | CCCUAUCCUUCCCCUUCCCUU | 1932 |
| D-1425 | 138-156 | 138-156 | UCUGUUUACUGUCCAAAGUUU | 430 | ACUUUGGACAGUAAACAGAUU | 1933 |
| D-1426 | 1382-1400 | 1265-1283 | GGAAGGGGAAGGAUAGGGUUU | 431 | ACCCUAUCCUUCCCCUUCCUU | 1934 |
| D-1427 | 1383-1401 | 1266-1284 | GAAGGGGAAGGAUAGGGUGUU | 432 | CACCCUAUCCUUCCCCUUCUU | 1935 |
| D-1428 | 1384-1402 | 1267-1285 | AAGGGGAAGGAUAGGGUGAUU | 433 | UCACCCUAUCCUUCCCCUUUU | 1936 |
| D-1429 | 1385-1403 | 1268-1286 | AGGGGAAGGAUAGGGUGAUUU | 434 | AUCACCCUAUCCUUCCCCUUU | 1937 |
| D-1430 | 1386-1404 | 1269-1287 | GGGGAAGGAUAGGGUGAUGUU | 435 | CAUCACCCUAUCCUUCCCCUU | 1938 |
| D-1431 | 1387-1405 | 1270-1288 | GGGAAGGAUAGGGUGAUGUUU | 436 | ACAUCACCCUAUCCUUCCCUU | 1939 |
| D-1432 | 1388-1406 | 1271-1289 | GGAAGGAUAGGGUGAUGUUUU | 437 | AACAUCACCCUAUCCUUCCUU | 1940 |
| D-1433 | 1389-1407 | 1272-1290 | GAAGGAUAGGGUGAUGUUCUU | 438 | GAACAUCACCCUAUCCUUCUU | 1941 |
| D-1434 | 1390-1408 | 1273-1291 | AAGGAUAGGGUGAUGUUCCUU | 439 | GGAACAUCACCCUAUCCUUUU | 1942 |
| D-1435 | 1391-1409 | 1274-1292 | AGGAUAGGGUGAUGUUCCGUU | 440 | CGGAACAUCACCCUAUCCUUU | 1943 |
| D-1436 | 139-157 | 139-157 | CUGUUUACUGUCCAAAGUCUU | 441 | GACUUUGGACAGUAAACAGUU | 1944 |
| D-1437 | 1392-1410 | 1275-1293 | GGAUAGGGUGAUGUUCCGAUU | 442 | UCGGAACAUCACCCUAUCCUU | 1945 |
| D-1438 | 1393-1411 | 1276-1294 | GAUAGGGUGAUGUUCCGAAUU | 443 | UUCGGAACAUCACCCUAUCUU | 1946 |
| D-1439 | 1394-1412 | 1277-1295 | AUAGGGUGAUGUUCCGAAGUU | 444 | CUUCGGAACAUCACCCUAUUU | 1947 |
| D-1440 | 1395-1413 | 1278-1296 | UAGGGUGAUGUUCCGAAGGUU | 445 | CCUUCGGAACAUCACCCUAUU | 1948 |
| D-1441 | 1396-1414 | 1279-1297 | AGGGUGAUGUUCCGAAGGUUU | 446 | ACCUUCGGAACAUCACCCUUU | 1949 |
| D-1442 | 1397-1415 | 1280-1298 | GGGUGAUGUUCCGAAGGUGUU | 447 | CACCUUCGGAACAUCACCCUU | 1950 |
| D-1443 | 1398-1416 | 1281-1299 | GGUGAUGUUCCGAAGGUGAUU | 448 | UCACCUUCGGAACAUCACCUU | 1951 |
| D-1444 | 1399-1417 | 1282-1300 | GUGAUGUUCCGAAGGUGAGUU | 449 | CUCACCUUCGGAACAUCACUU | 1952 |
| D-1445 | 1400-1418 | 1283-1301 | UGAUGUUCCGAAGGUGAGGUU | 450 | CCUCACCUUCGGAACAUCAUU | 1953 |
| D-1446 | 1401-1419 | 1284-1302 | GAUGUUCCGAAGGUGAGGAUU | 451 | UCCUCACCUUCGGAACAUCUU | 1954 |
| D-1447 | 140-158 | 140-158 | UGUUUACUGUCCAAAGUCCUU | 452 | GGACUUUGGACAGUAAACAUU | 1955 |
| D-1448 | 1402-1420 | 1285-1303 | AUGUUCCGAAGGUGAGGAGUU | 453 | CUCCUCACCUUCGGAACAUUU | 1956 |
| D-1449 | 1403-1421 | 1286-1304 | UGUUCCGAAGGUGAGGAGCUU | 454 | GCUCCUCACCUUCGGAACAUU | 1957 |
| D-1450 | 1404-1422 | 1287-1305 | GUUCCGAAGGUGAGGAGCUUU | 455 | AGCUCCUCACCUUCGGAACUU | 1958 |
| D-1451 | 1405-1423 | 1288-1306 | UUCCGAAGGUGAGGAGCUUUU | 456 | AAGCUCCUCACCUUCGGAAUU | 1959 |
| D-1452 | 1406-1424 | 1289-1307 | UCCGAAGGUGAGGAGCUUGUU | 457 | CAAGCUCCUCACCUUCGGAUU | 1960 |
| D-1453 | 1407-1425 | 1290-1308 | CCGAAGGUGAGGAGCUUGAUU | 458 | UCAAGCUCCUCACCUUCGGUU | 1961 |
| D-1454 | 1408-1426 | 1291-1309 | CGAAGGUGAGGAGCUUGAAUU | 459 | UUCAAGCUCCUCACCUUCGUU | 1962 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1455 | 1409-1427 | 1292-1310 | GAAGGUGAGGAGCUUGAAAUU | 460 | UUUCAAGCUCCUCACCUUCUU | 1963 |
| D-1456 | 1410-1428 | 1293-1311 | AAGGUGAGGAGCUUGAAACUU | 461 | GUUUCAAGCUCCUCACCUUUU | 1964 |
| D-1457 | 1411-1429 | 1294-1312 | AGGUGAGGAGCUUGAAACCUU | 462 | GGUUUCAAGCUCCUCACCUUU | 1965 |
| D-1458 | 141-159 | 141-159 | GUUUACUGUCCAAAGUCCCUU | 463 | GGGACUUUGGACAGUAAACUU | 1966 |
| D-1459 | 1412-1430 | 1295-1313 | GGUGAGGAGCUUGAAACCCUU | 464 | GGGUUUCAAGCUCCUCACCUU | 1967 |
| D-1460 | 1413-1431 | 1296-1314 | GUGAGGAGCUUGAAACCCGUU | 465 | CGGGUUUCAAGCUCCUCACUU | 1968 |
| D-1461 | 1414-1432 | 1297-1315 | UGAGGAGCUUGAAACCCGUUU | 466 | ACGGGUUUCAAGCUCCUCAUU | 1969 |
| D-1462 | 1415-1433 | 1298-1316 | GAGGAGCUUGAAACCCGUGUU | 467 | CACGGGUUUCAAGCUCCUCUU | 1970 |
| D-1463 | 1416-1434 | 1299-1317 | AGGAGCUUGAAACCCGUGGUU | 468 | CCACGGGUUUCAAGCUCCUUU | 1971 |
| D-1464 | 1417-1435 | 1300-1318 | GGAGCUUGAAACCCGUGGCUU | 469 | GCCACGGGUUUCAAGCUCCUU | 1972 |
| D-1465 | 1418-1436 | 1301-1319 | GAGCUUGAAACCCGUGGCGUU | 470 | CGCCACGGGUUUCAAGCUCUU | 1973 |
| D-1466 | 1419-1437 | 1302-1320 | AGCUUGAAACCCGUGGCGCUU | 471 | GCGCCACGGGUUUCAAGCUUU | 1974 |
| D-1467 | 1420-1438 | 1303-1321 | GCUUGAAACCCGUGGCGCUUU | 472 | AGCGCCACGGGUUUCAAGCUU | 1975 |
| D-1468 | 1421-1439 | 1304-1322 | CUUGAAACCCGUGGCGCUUUU | 473 | AAGCGCCACGGGUUUCAAGUU | 1976 |
| D-1469 | 142-160 | 142-160 | UUUACUGUCCAAAGUCCCGUU | 474 | CGGGACUUUGGACAGUAAAUU | 1977 |
| D-1470 | 1422-1440 | 1305-1323 | UUGAAACCCGUGGCGCUUUUU | 475 | AAAGCGCCACGGGUUUCAAUU | 1978 |
| D-1471 | 1423-1441 | 1306-1324 | UGAAACCCGUGGCGCUUUCUU | 476 | GAAAGCGCCACGGGUUUCAUU | 1979 |
| D-1472 | 1424-1442 | 1307-1325 | GAAACCCGUGGCGCUUUCUUU | 477 | AGAAAGCGCCACGGGUUUCUU | 1980 |
| D-1473 | 1425-1443 | 1308-1326 | AAACCCGUGGCGCUUUCUGUU | 478 | CAGAAAGCGCCACGGGUUUUU | 1981 |
| D-1474 | 1426-1444 | 1309-1327 | AACCCGUGGCGCUUUCUGCUU | 479 | GCAGAAAGCGCCACGGGUUUU | 1982 |
| D-1475 | 1427-1445 | 1310-1328 | ACCCGUGGCGCUUUCUGCAUU | 480 | UGCAGAAAGCGCCACGGGUUU | 1983 |
| D-1476 | 1428-1446 | 1311-1329 | CCCGUGGCGCUUUCUGCAGUU | 481 | CUGCAGAAAGCGCCACGGGUU | 1984 |
| D-1477 | 1429-1447 | 1312-1330 | CCGUGGCGCUUUCUGCAGUUU | 482 | ACUGCAGAAAGCGCCACGGUU | 1985 |
| D-1478 | 1430-1448 | 1313-1331 | CGUGGCGCUUUCUGCAGUUUU | 483 | AACUGCAGAAAGCGCCACGUU | 1986 |
| D-1479 | 1431-1449 | 1314-1332 | GUGGCGCUUUCUGCAGUUUUU | 484 | AAACUGCAGAAAGCGCCACUU | 1987 |
| D-1480 | 143-161 | 143-161 | UUACUGUCCAAAGUCCCGGUU | 485 | CCGGGACUUUGGACAGUAAUU | 1988 |
| D-1481 | 14-32 | 14-32 | CGGAAGAGUGAGGUGACUGUU | 486 | CAGUCACCUCACUCUUCCGUU | 1989 |
| D-1482 | 1432-1450 | 1315-1333 | UGGCGCUUUCUGCAGUUUGUU | 487 | CAAACUGCAGAAAGCGCCAUU | 1990 |
| D-1483 | 1433-1451 | 1316-1334 | GGCGCUUUCUGCAGUUUGCUU | 488 | GCAAACUGCAGAAAGCGCCUU | 1991 |
| D-1484 | 1434-1452 | 1317-1335 | GCGCUUUCUGCAGUUUGCAUU | 489 | UGCAAACUGCAGAAAGCGCUU | 1992 |
| D-1485 | 1435-1453 | 1318-1336 | CGCUUUCUGCAGUUUGCAGUU | 490 | CUGCAAACUGCAGAAAGCGUU | 1993 |
| D-1486 | 1436-1454 | 1319-1337 | GCUUUCUGCAGUUUGCAGGUU | 491 | CCUGCAAACUGCAGAAAGCUU | 1994 |
| D-1487 | 1437-1455 | 1320-1338 | CUUUCUGCAGUUUGCAGGUUU | 492 | ACCUGCAAACUGCAGAAAGUU | 1995 |
| D-1488 | 1438-1456 | 1321-1339 | UUUCUGCAGUUUGCAGGUUUU | 493 | AACCUGCAAACUGCAGAAAUU | 1996 |
| D-1489 | 1439-1457 | 1322-1340 | UUCUGCAGUUUGCAGGUUAUU | 494 | UAACCUGCAAACUGCAGAAUU | 1997 |
| D-1490 | 1440-1458 | 1323-1341 | UCUGCAGUUUGCAGGUUAUUU | 495 | AUAACCUGCAAACUGCAGAUU | 1998 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1491 | 1441-1459 | 1324-1342 | CUGCAGUUUGCAGGUUAUCUU | 496 | GAUAACCUGCAAACUGCAGUU | 1999 |
| D-1492 | 144-162 | 144-162 | UACUGUCCAAAGUCCCGGGUU | 497 | CCCGGGACUUUGGACAGUAUU | 2000 |
| D-1493 | 1442-1460 | 1325-1343 | UGCAGUUUGCAGGUUAUCAUU | 498 | UGAUAACCUGCAAACUGCAUU | 2001 |
| D-1494 | 1443-1461 | 1326-1344 | GCAGUUUGCAGGUUAUCAUUU | 499 | AUGAUAACCUGCAAACUGCUU | 2002 |
| D-1495 | 1444-1462 | 1327-1345 | CAGUUUGCAGGUUAUCAUUUU | 500 | AAUGAUAACCUGCAAACUGUU | 2003 |
| D-1496 | 1445-1463 | 1328-1346 | AGUUUGCAGGUUAUCAUUGUU | 501 | CAAUGAUAACCUGCAAACUUU | 2004 |
| D-1497 | 1446-1464 | 1329-1347 | GUUUGCAGGUUAUCAUUGUUU | 502 | ACAAUGAUAACCUGCAAACUU | 2005 |
| D-1498 | 1447-1465 | 1330-1348 | UUUGCAGGUUAUCAUUGUGUU | 503 | CACAAUGAUAACCUGCAAAUU | 2006 |
| D-1499 | 1448-1466 | 1331-1349 | UUGCAGGUUAUCAUUGUGAUU | 504 | UCACAAUGAUAACCUGCAAUU | 2007 |
| D-1500 | 1449-1467 | 1332-1350 | UGCAGGUUAUCAUUGUGAAUU | 505 | UUCACAAUGAUAACCUGCAUU | 2008 |
| D-1501 | 1450-1468 | 1333-1351 | GCAGGUUAUCAUUGUGAACUU | 506 | GUUCACAAUGAUAACCUGCUU | 2009 |
| D-1502 | 1451-1469 | 1334-1352 | CAGGUUAUCAUUGUGAACUUU | 507 | AGUUCACAAUGAUAACCUGUU | 2010 |
| D-1503 | 145-163 | 145-163 | ACUGUCCAAAGUCCCGGGCUU | 508 | GCCCGGGACUUUGGACAGUUU | 2011 |
| D-1504 | 1452-1470 | 1335-1353 | AGGUUAUCAUUGUGAACUUUU | 509 | AAGUUCACAAUGAUAACCUUU | 2012 |
| D-1505 | 1453-1471 | 1336-1354 | GGUUAUCAUUGUGAACUUUUU | 510 | AAAGUUCACAAUGAUAACCUU | 2013 |
| D-1506 | 1454-1472 | 1337-1355 | GUUAUCAUUGUGAACUUUUUU | 511 | AAAAGUUCACAAUGAUAACUU | 2014 |
| D-1507 | 1455-1473 | 1338-1356 | UUAUCAUUGUGAACUUUUUUU | 512 | AAAAAGUUCACAAUGAUAAUU | 2015 |
| D-1508 | 1456-1474 | 1339-1357 | UAUCAUUGUGAACUUUUUUUU | 513 | AAAAAAGUUCACAAUGAUAUU | 2016 |
| D-1509 | 1457-1475 | 1340-1358 | AUCAUUGUGAACUUUUUUUUU | 514 | AAAAAAAGUUCACAAUGAUUU | 2017 |
| D-1510 | 1458-1476 | 1341-1359 | UCAUUGUGAACUUUUUUUUUU | 515 | AAAAAAAAGUUCACAAUGAUU | 2018 |
| D-1511 | 1459-1477 | 1342-1360 | CAUUGUGAACUUUUUUUUUUU | 516 | AAAAAAAAAGUUCACAAUGUU | 2019 |
| D-1512 | 1460-1478 | 1343-1361 | AUUGUGAACUUUUUUUUUUUU | 517 | AAAAAAAAAAGUUCACAAUUU | 2020 |
| D-1513 | 1461-1479 | 1344-1362 | UUGUGAACUUUUUUUUUUUUU | 518 | AAAAAAAAAAAGUUCACAAUU | 2021 |
| D-1514 | 146-164 | 146-164 | CUGUCCAAAGUCCCGGGCAUU | 519 | UGCCCGGGACUUUGGACAGUU | 2022 |
| D-1515 | 1462-1480 | 1345-1363 | UGUGAACUUUUUUUUUUUAUU | 520 | UAAAAAAAAAAAGUUCACAUU | 2023 |
| D-1516 | 1463-1481 | 1346-1364 | GUGAACUUUUUUUUUUUAAUU | 521 | UUAAAAAAAAAAAGUUCACUU | 2024 |
| D-1517 | 1464-1482 | 1347-1365 | UGAACUUUUUUUUUUUAAGUU | 522 | CUUAAAAAAAAAAAGUUCAUU | 2025 |
| D-1518 | 1465-1483 | 1348-1366 | GAACUUUUUUUUUUUAAGAUU | 523 | UCUUAAAAAAAAAAAGUUCUU | 2026 |
| D-1519 | 1466-1484 | 1349-1367 | AACUUUUUUUUUUUAAGAGUU | 524 | CUCUUAAAAAAAAAAAGUUUU | 2027 |
| D-1520 | 1467-1485 | 1350-1368 | ACUUUUUUUUUUUAAGAGUUU | 525 | ACUCUUAAAAAAAAAAAGUUU | 2028 |
| D-1521 | 1468-1486 | 1351-1369 | CUUUUUUUUUUUAAGAGUAUU | 526 | UACUCUUAAAAAAAAAAAGUU | 2029 |
| D-1522 | 1469-1487 | 1352-1370 | UUUUUUUUUUUAAGAGUAAUU | 527 | UUACUCUUAAAAAAAAAAAUU | 2030 |
| D-1523 | 1470-1488 | 1353-1371 | UUUUUUUUUUAAGAGUAAAUU | 528 | UUUACUCUUAAAAAAAAAAUU | 2031 |
| D-1524 | 1471-1489 | 1354-1372 | UUUUUUUUUAAGAGUAAAAUU | 529 | UUUUACUCUUAAAAAAAAAUU | 2032 |
| D-1525 | 147-165 | 147-165 | UGUCCAAAGUCCCGGGCACUU | 530 | GUGCCCGGGACUUUGGACAUU | 2033 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1526 | 1472-1490 | 1355-1373 | UUUUUUUUAAGAGUAAAAAUU | 531 | UUUUUACUCUUAAAAAAAAUU | 2034 |
| D-1527 | 1473-1491 | 1356-1374 | UUUUUUUAAGAGUAAAAAGUU | 532 | CUUUUUACUCUUAAAAAAAUU | 2035 |
| D-1528 | 1474-1492 | 1357-1375 | UUUUUUAAGAGUAAAAAGAUU | 533 | UCUUUUUACUCUUAAAAAAUU | 2036 |
| D-1529 | 1475-1493 | 1358-1376 | UUUUUAAGAGUAAAAAGAAUU | 534 | UUCUUUUUACUCUUAAAAAUU | 2037 |
| D-1530 | 1476-1494 | 1359-1377 | UUUUAAGAGUAAAAAGAAAUU | 535 | UUUCUUUUUACUCUUAAAAUU | 2038 |
| D-1531 | 1477-1495 | 1360-1378 | UUUAAGAGUAAAAAGAAAUUU | 536 | AUUUCUUUUUACUCUUAAAUU | 2039 |
| D-1532 | 1478-1496 | 1361-1379 | UUAAGAGUAAAAAGAAAUAUU | 537 | UAUUUCUUUUUACUCUUAAUU | 2040 |
| D-1533 | 1479-1497 | 1362-1380 | UAAGAGUAAAAAGAAAUAUUU | 538 | AUAUUUCUUUUUACUCUUAUU | 2041 |
| D-1534 | 1480-1498 | 1363-1381 | AAGAGUAAAAAGAAAUAUAUU | 539 | UAUAUUUCUUUUUACUCUUUU | 2042 |
| D-1535 | 1481-1499 | 1364-1382 | AGAGUAAAAAGAAAUAUACUU | 540 | GUAUAUUUCUUUUUACUCUUU | 2043 |
| D-1536 | 148-166 | 148-166 | GUCCAAAGUCCCGGGCACUUU | 541 | AGUGCCCGGGACUUUGGACUU | 2044 |
| D-1537 | 1482-1500 | 1365-1383 | GAGUAAAAAGAAAUAUACCUU | 542 | GGUAUAUUUCUUUUUACUCUU | 2045 |
| D-1538 | 1483-1501 | — | AGUAAAAAGAAAUAUACCUUU | 543 | AGGUAUAUUUCUUUUUACUUU | 2046 |
| D-1539 | 1484-1502 | — | GUAAAAAGAAAUAUACCUAUU | 544 | UAGGUAUAUUUCUUUUUACUU | 2047 |
| D-1540 | 1485-1503 | — | UAAAAAGAAAUAUACCUAAUU | 545 | UUAGGUAUAUUUCUUUUUAUU | 2048 |
| D-1541 | 149-167 | 149-167 | UCCAAAGUCCCGGGCACUGUU | 546 | CAGUGCCCGGGACUUUGGAUU | 2049 |
| D-1542 | 150-168 | 150-168 | CCAAAGUCCCGGGCACUGGUU | 547 | CCAGUGCCCGGGACUUUGGUU | 2050 |
| D-1543 | 151-169 | 151-169 | CAAAGUCCCGGGCACUGGAUU | 548 | UCCAGUGCCCGGGACUUUGUU | 2051 |
| D-1544 | 152-170 | 152-170 | AAAGUCCCGGGCACUGGAGUU | 549 | CUCCAGUGCCCGGGACUUUUU | 2052 |
| D-1545 | 153-171 | 153-171 | AAGUCCCGGGCACUGGAGAUU | 550 | UCUCCAGUGCCCGGGACUUUU | 2053 |
| D-1546 | 15-33 | 15-33 | GGAAGAGUGAGGUGACUGGUU | 551 | CCAGUCACCUCACUCUUCCUU | 2054 |
| D-1547 | 154-172 | 154-172 | AGUCCCGGGCACUGGAGAUUU | 552 | AUCUCCAGUGCCCGGGACUUU | 2055 |
| D-1548 | 155-173 | 155-173 | GUCCCGGGCACUGGAGAUGUU | 553 | CAUCUCCAGUGCCCGGGACUU | 2056 |
| D-1549 | 156-174 | 156-174 | UCCCGGGCACUGGAGAUGCUU | 554 | GCAUCUCCAGUGCCCGGGAUU | 2057 |
| D-1550 | 157-175 | 157-175 | CCCGGGCACUGGAGAUGCCUU | 555 | GGCAUCUCCAGUGCCCGGGUU | 2058 |
| D-1551 | 158-176 | 158-176 | CCGGGCACUGGAGAUGCCAUU | 556 | UGGCAUCUCCAGUGCCCGGUU | 2059 |
| D-1552 | 159-177 | 159-177 | CGGGCACUGGAGAUGCCACUU | 557 | GUGGCAUCUCCAGUGCCCGUU | 2060 |
| D-1553 | 160-178 | 160-178 | GGGCACUGGAGAUGCCACGUU | 558 | CGUGGCAUCUCCAGUGCCCUU | 2061 |
| D-1554 | 161-179 | 161-179 | GGCACUGGAGAUGCCACGUUU | 559 | ACGUGGCAUCUCCAGUGCCUU | 2062 |
| D-1555 | 162-180 | 162-180 | GCACUGGAGAUGCCACGUUUU | 560 | AACGUGGCAUCUCCAGUGCUU | 2063 |
| D-1556 | 163-181 | 163-181 | CACUGGAGAUGCCACGUUUUU | 561 | AAACGUGGCAUCUCCAGUGUU | 2064 |
| D-1557 | 16-34 | 16-34 | GAAGAGUGAGGUGACUGGCUU | 562 | GCCAGUCACCUCACUCUUCUU | 2065 |
| D-1558 | 164-182 | 164-182 | ACUGGAGAUGCCACGUUUGUU | 563 | CAAACGUGGCAUCUCCAGUUU | 2066 |
| D-1559 | 165-183 | 165-183 | CUGGAGAUGCCACGUUUGGUU | 564 | CCAAACGUGGCAUCUCCAGUU | 2067 |
| D-1560 | 166-184 | 166-184 | UGGAGAUGCCACGUUUGGCUU | 565 | GCCAAACGUGGCAUCUCCAUU | 2068 |
| D-1561 | 167-185 | 167-185 | GGAGAUGCCACGUUUGGCGUU | 566 | CGCCAAACGUGGCAUCUCCUU | 2069 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1562 | 168-186 | 168-186 | GAGAUGCCACGUUUGGCGUUU | 567 | ACGCCAAACGUGGCAUCUCUU | 2070 |
| D-1563 | 169-187 | 169-187 | AGAUGCCACGUUUGGCGUGUU | 568 | CACGCCAAACGUGGCAUCUUU | 2071 |
| D-1564 | 170-188 | 170-188 | GAUGCCACGUUUGGCGUGCUU | 569 | GCACGCCAAACGUGGCAUCUU | 2072 |
| D-1565 | 171-189 | 171-189 | AUGCCACGUUUGGCGUGCUUU | 570 | AGCACGCCAAACGUGGCAUUU | 2073 |
| D-1566 | 172-190 | 172-190 | UGCCACGUUUGGCGUGCUUUU | 571 | AAGCACGCCAAACGUGGCAUU | 2074 |
| D-1567 | 173-191 | 173-191 | GCCACGUUUGGCGUGCUUGUU | 572 | CAAGCACGCCAAACGUGGCUU | 2075 |
| D-1568 | 17-35 | 17-35 | AAGAGUGAGGUGACUGGCAUU | 573 | UGCCAGUCACCUCACUCUUUU | 2076 |
| D-1569 | 174-192 | 174-192 | CCACGUUUGGCGUGCUUGGUU | 574 | CCAAGCACGCCAAACGUGGUU | 2077 |
| D-1570 | 175-193 | 175-193 | CACGUUUGGCGUGCUUGGAUU | 575 | UCCAAGCACGCCAAACGUGUU | 2078 |
| D-1571 | 176-194 | 176-194 | ACGUUUGGCGUGCUUGGACUU | 576 | GUCCAAGCACGCCAAACGUUU | 2079 |
| D-1572 | 177-195 | 177-195 | CGUUUGGCGUGCUUGGACAUU | 577 | UGUCCAAGCACGCCAAACGUU | 2080 |
| D-1573 | 178-196 | 178-196 | GUUUGGCGUGCUUGGACACUU | 578 | GUGUCCAAGCACGCCAAACUU | 2081 |
| D-1574 | 179-497 | 179-197 | UUUGGCGUGCUUGGACACAUU | 579 | UGUGUCCAAGCACGCCAAAUU | 2082 |
| D-1575 | 180-198 | 180-198 | UUGGCGUGCUUGGACACACUU | 580 | GUGUGUCCAAGCACGCCAAUU | 2083 |
| D-1576 | 181-199 | 181-199 | UGGCGUGCUUGGACACACAUU | 581 | UGUGUGUCCAAGCACGCCAUU | 2084 |
| D-1577 | 182-200 | 182-200 | GGCGUGCUUGGACACACAGUU | 582 | CUGUGUGUCCAAGCACGCCUU | 2085 |
| D-1578 | 183-201 | 183-201 | GCGUGCUUGGACACACAGAUU | 583 | UCUGUGUGUCCAAGCACGCUU | 2086 |
| D-1579 | 18-36 | 18-36 | AGAGUGAGGUGACUGGCAUUU | 584 | AUGCCAGUCACCUCACUCUUU | 2087 |
| D-1580 | 184-202 | 184-202 | CGUGCUUGGACACACAGACUU | 585 | GUCUGUGUGUCCAAGCACGUU | 2088 |
| D-1581 | 185-203 | 185-203 | GUGCUUGGACACACAGACAUU | 586 | UGUCUGUGUGUCCAAGCACUU | 2089 |
| D-1582 | 186-204 | 186-204 | UGCUUGGACACACAGACACUU | 587 | GUGUCUGUGUGUCCAAGCAUU | 2090 |
| D-1583 | 187-205 | 187-205 | GCUUGGACACACAGACACGUU | 588 | CGUGUCUGUGUGUCCAAGCUU | 2091 |
| D-1584 | 188-206 | 188-206 | CUUGGACACACAGACACGCUU | 589 | GCGUGUCUGUGUGUCCAAGUU | 2092 |
| D-1585 | 189-207 | 189-207 | UUGGACACACAGACACGCAUU | 590 | UGCGUGUCUGUGUGUCCAAUU | 2093 |
| D-1586 | 190-208 | 190-208 | UGGACACACAGACACGCAGUU | 591 | CUGCGUGUCUGUGUGUCCAUU | 2094 |
| D-1587 | 191-209 | 191-209 | GGACACACAGACACGCAGAUU | 592 | UCUGCGUGUCUGUGUGUCCUU | 2095 |
| D-1588 | 192-210 | 192-210 | GACACACAGACACGCAGACUU | 593 | GUCUGCGUGUCUGUGUGUCUU | 2096 |
| D-1589 | 193-211 | 193-211 | ACACACAGACACGCAGACAUU | 594 | UGUCUGCGUGUCUGUGUGUUU | 2097 |
| D-1590 | 19-37 | 19-37 | GAGUGAGGUGACUGGCAUGUU | 595 | CAUGCCAGUCACCUCACUCUU | 2098 |
| D-1591 | 194-212 | 194-212 | CACACAGACACGCAGACACUU | 596 | GUGUCUGCGUGUCUGUGUGUU | 2099 |
| D-1592 | 195-213 | 195-213 | ACACAGACACGCAGACACAUU | 597 | UGUGUCUGCGUGUCUGUGUUU | 2100 |
| D-1593 | 196-214 | 196-214 | CACAGACACGCAGACACAGUU | 598 | CUGUGUCUGCGUGUCUGUGUU | 2101 |
| D-1594 | 197-215 | 197-215 | ACAGACACGCAGACACAGAUU | 599 | UCUGUGUCUGCGUGUCUGUUU | 2102 |
| D-1595 | 198-216 | 198-216 | CAGACACGCAGACACAGAGUU | 600 | CUCUGUGUCUGCGUGUCUGUU | 2103 |
| D-1596 | 199-217 | 199-217 | AGACACGCAGACACAGAGAUU | 601 | UCUCUGUGUCUGCGUGUCUUU | 2104 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1597 | 200-218 | 200-218 | GACACGCAGACACAGAGACUU | 602 | GUCUCUGUGUCUGCGUGUCUU | 2105 |
| D-1598 | 201-219 | 201-219 | ACACGCAGACACAGAGACAUU | 603 | UGUCUCUGUGUCUGCGUGUUU | 2106 |
| D-1599 | 202-220 | 202-220 | CACGCAGACACAGAGACACUU | 604 | GUGUCUCUGUGUCUGCGUGUU | 2107 |
| D-1600 | 203-221 | 203-221 | ACGCAGACACAGAGACACCUU | 605 | GGUGUCUCUGUGUCUGCGUUU | 2108 |
| D-1601 | 20-38 | 20-38 | AGUGAGGUGACUGGCAUGUUU | 606 | ACAUGCCAGUCACCUCACUUU | 2109 |
| D-1602 | 204-222 | 204-222 | CGCAGACACAGAGACACCGUU | 607 | CGGUGUCUCUGUGUCUGCGUU | 2110 |
| D-1603 | 205-223 | 205-223 | GCAGACACAGAGACACCGGUU | 608 | CCGGUGUCUCUGUGUCUGCUU | 2111 |
| D-1604 | 206-224 | 206-224 | CAGACACAGAGACACCGGGUU | 609 | CCCGGUGUCUCUGUGUCUGUU | 2112 |
| D-1605 | 207-225 | 207-225 | AGACACAGAGACACCGGGGUU | 610 | CCCCGGUGUCUCUGUGUCUUU | 2113 |
| D-1606 | 208-226 | 208-226 | GACACAGAGACACCGGGGCUU | 611 | GCCCCGGUGUCUCUGUGUCUU | 2114 |
| D-1607 | 209-227 | 209-227 | ACACAGAGACACCGGGGCCUU | 612 | GGCCCCGGUGUCUCUGUGUUU | 2115 |
| D-1608 | 210-228 | 210-228 | CACAGAGACACCGGGGCCCUU | 613 | GGGCCCCGGUGUCUCUGUGUU | 2116 |
| D-1609 | 211-229 | 211-229 | ACAGAGACACCGGGGCCCAUU | 614 | UGGGCCCCGGUGUCUCUGUUU | 2117 |
| D-1610 | 212-230 | 212-230 | CAGAGACACCGGGGCCCAGUU | 615 | CUGGGCCCCGGUGUCUCUGUU | 2118 |
| D-1611 | 213-231 | 213-231 | AGAGACACCGGGGCCCAGGUU | 616 | CCUGGGCCCCGGUGUCUCUUU | 2119 |
| D-1612 | 21-39 | 21-39 | GUGAGGUGACUGGCAUGUGUU | 617 | CACAUGCCAGUCACCUCACUU | 2120 |
| D-1613 | 214-232 | 214-232 | GAGACACCGGGGCCCAGGGUU | 618 | CCCUGGGCCCCGGUGUCUCUU | 2121 |
| D-1614 | 215-233 | 215-233 | AGACACCGGGGCCCAGGGCUU | 619 | GCCCUGGGCCCCGGUGUCUUU | 2122 |
| D-1615 | 216-234 | 216-234 | GACACCGGGGCCCAGGGCCUU | 620 | GGCCCUGGGCCCCGGUGUCUU | 2123 |
| D-1616 | 217-235 | 217-235 | ACACCGGGGCCCAGGGCCCUU | 621 | GGGCCCUGGGCCCCGGUGUUU | 2124 |
| D-1617 | 218-236 | 218-236 | CACCGGGGCCCAGGGCCCUUU | 622 | AGGGCCCUGGGCCCCGGUGUU | 2125 |
| D-1618 | 219-237 | 219-237 | ACCGGGGCCCAGGGCCCUCUU | 623 | GAGGGCCCUGGGCCCCGGUUU | 2126 |
| D-1619 | 2-20 | 2-20 | CCAAACGGUGCACGGAAGAUU | 624 | UCUUCCGUGCACCGUUUGGUU | 2127 |
| D-1620 | 220-238 | 220-238 | CCGGGGCCCAGGGCCCUCCUU | 625 | GGAGGGCCCUGGGCCCCGGUU | 2128 |
| D-1621 | 221-239 | 221-239 | CGGGGCCCAGGGCCCUCCUUU | 626 | AGGAGGGCCCUGGGCCCCGUU | 2129 |
| D-1622 | 222-240 | 222-240 | GGGGCCCAGGGCCCUCCUAUU | 627 | UAGGAGGGCCCUGGGCCCCUU | 2130 |
| D-1623 | 223-241 | 223-241 | GGGCCCAGGGCCCUCCUAUUU | 628 | AUAGGAGGGCCCUGGGCCCUU | 2131 |
| D-1624 | 22-40 | 22-40 | UGAGGUGACUGGCAUGUGUUU | 629 | ACACAUGCCAGUCACCUCAUU | 2132 |
| D-1625 | 224-242 | 224-242 | GGCCCAGGGCCCUCCUAUGUU | 630 | CAUAGGAGGGCCCUGGGCCUU | 2133 |
| D-1626 | 225-243 | 225-243 | GCCCAGGGCCCUCCUAUGGUU | 631 | CCAUAGGAGGGCCCUGGGCUU | 2134 |
| D-1627 | 226-244 | 226-244 | CCCAGGGCCCUCCUAUGGAUU | 632 | UCCAUAGGAGGGCCCUGGGUU | 2135 |
| D-1628 | 227-245 | 227-245 | CCAGGGCCCUCCUAUGGACUU | 633 | GUCCAUAGGAGGGCCCUGGUU | 2136 |
| D-1629 | 228-246 | 228-246 | CAGGGCCCUCCUAUGGACCUU | 634 | GGUCCAUAGGAGGGCCCUGUU | 2137 |
| D-1630 | 229-247 | 229-247 | AGGGCCCUCCUAUGGACCCUU | 635 | GGGUCCAUAGGAGGGCCCUUU | 2138 |
| D-1631 | 230-248 | 230-248 | GGGCCCUCCUAUGGACCCUUU | 636 | AGGGUCCAUAGGAGGGCCCUU | 2139 |
| D-1632 | 231-249 | 231-249 | GGCCCUCCUAUGGACCCUGUU | 637 | CAGGGUCCAUAGGAGGGCCUU | 2140 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1633 | 232-250 | 232-250 | GCCCUCCUAUGGACCCUGCUU | 638 | GCAGGGUCCAUAGGAGGGCUU | 2141 |
| D-1634 | 233-251 | 233-251 | CCCUCCUAUGGACCCUGCCUU | 639 | GGCAGGGUCCAUAGGAGGGUU | 2142 |
| D-1635 | 23-41 | 23-41 | GAGGUGACUGGCAUGUGUGUU | 640 | CACACAUGCCAGUCACCUCUU | 2143 |
| D-1636 | 234-252 | 234-252 | CCUCCUAUGGACCCUGCCCUU | 641 | GGGCAGGGUCCAUAGGAGGUU | 2144 |
| D-1637 | 235-253 | 235-253 | CUCCUAUGGACCCUGCCCGUU | 642 | CGGGCAGGGUCCAUAGGAGUU | 2145 |
| D-1638 | 236-254 | 236-254 | UCCUAUGGACCCUGCCCGCUU | 643 | GCGGGCAGGGUCCAUAGGAUU | 2146 |
| D-1639 | 237-255 | 237-255 | CCUAUGGACCCUGCCCGCUUU | 644 | AGCGGGCAGGGUCCAUAGGUU | 2147 |
| D-1640 | 238-256 | 238-256 | CUAUGGACCCUGCCCGCUCUU | 645 | GAGCGGGCAGGGUCCAUAGUU | 2148 |
| D-1641 | 239-257 | 239-257 | UAUGGACCCUGCCCGCUCCUU | 646 | GGAGCGGGCAGGGUCCAUAUU | 2149 |
| D-1642 | 240-258 | 240-258 | AUGGACCCUGCCCGCUCCCUU | 647 | GGGAGCGGGCAGGGUCCAUUU | 2150 |
| D-1643 | 241-259 | 241-259 | UGGACCCUGCCCGCUCCCCUU | 648 | GGGGAGCGGGCAGGGUCCAUU | 2151 |
| D-1644 | 242-260 | 242-260 | GGACCCUGCCCGCUCCCCUUU | 649 | AGGGGAGCGGGCAGGGUCCUU | 2152 |
| D-1645 | 243-261 | 243-261 | GACCCUGCCCGCUCCCCUCUU | 650 | GAGGGGAGCGGGCAGGGUCUU | 2153 |
| D-1646 | 24-42 | 24-42 | AGGUGACUGGCAUGUGUGGUU | 651 | CCACACAUGCCAGUCACCUUU | 2154 |
| D-1647 | 244-262 | 244-262 | ACCCUGCCCGCUCCCCUCCUU | 652 | GGAGGGGAGCGGGCAGGGUUU | 2155 |
| D-1648 | 245-263 | 245-263 | CCCUGCCCGCUCCCCUCCCUU | 653 | GGGAGGGGAGCGGGCAGGGUU | 2156 |
| D-1649 | 246-264 | 246-264 | CCUGCCCGCUCCCCUCCCAUU | 654 | UGGGAGGGGAGCGGGCAGGUU | 2157 |
| D-1650 | 247-265 | 247-265 | CUGCCCGCUCCCCUCCCAUUU | 655 | AUGGGAGGGGAGCGGGCAGUU | 2158 |
| D-1651 | 248-266 | 248-266 | UGCCCGCUCCCCUCCCAUUUU | 656 | AAUGGGAGGGGAGCGGGCAUU | 2159 |
| D-1652 | 249-267 | 249-267 | GCCCGCUCCCCUCCCAUUGUU | 657 | CAAUGGGAGGGGAGCGGGCUU | 2160 |
| D-1653 | 250-268 | 250-268 | CCCGCUCCCCUCCCAUUGUUU | 658 | ACAAUGGGAGGGGAGCGGGUU | 2161 |
| D-1654 | 251-269 | 251-269 | CCGCUCCCCUCCCAUUGUCUU | 659 | GACAAUGGGAGGGGAGCGGUU | 2162 |
| D-1655 | 252-270 | 252-270 | CGCUCCCCUCCCAUUGUCCUU | 660 | GGACAAUGGGAGGGGAGCGUU | 2163 |
| D-1656 | 253-271 | 253-271 | GCUCCCCUCCCAUUGUCCAUU | 661 | UGGACAAUGGGAGGGGAGCUU | 2164 |
| D-1657 | 254-272 | 254-272 | CUCCCCUCCCAUUGUCCACUU | 662 | GUGGACAAUGGGAGGGGAGUU | 2165 |
| D-1658 | 25-43 | 25-43 | GGUGACUGGCAUGUGUGGGUU | 663 | CCCACACAUGCCAGUCACCUU | 2166 |
| D-1659 | 255-273 | 255-273 | UCCCCUCCCAUUGUCCACGUU | 664 | CGUGGACAAUGGGAGGGGAUU | 2167 |
| D-1660 | 256-274 | 256-274 | CCCCUCCCAUUGUCCACGGUU | 665 | CCGUGGACAAUGGGAGGGGUU | 2168 |
| D-1661 | 257-275 | 257-275 | CCCUCCCAUUGUCCACGGCUU | 666 | GCCGUGGACAAUGGGAGGGUU | 2169 |
| D-1662 | 258-276 | 258-276 | CCUCCCAUUGUCCACGGCUUU | 667 | AGCCGUGGACAAUGGGAGGUU | 2170 |
| D-1663 | 259-277 | 259-277 | CUCCCAUUGUCCACGGCUGUU | 668 | CAGCCGUGGACAAUGGGAGUU | 2171 |
| D-1664 | 260-278 | 260-278 | UCCCAUUGUCCACGGCUGUUU | 669 | ACAGCCGUGGACAAUGGGAUU | 2172 |
| D-1665 | 261-279 | 261-279 | CCCAUUGUCCACGGCUGUCUU | 670 | GACAGCCGUGGACAAUGGGUU | 2173 |
| D-1666 | 262-280 | 262-280 | CCAUUGUCCACGGCUGUCCUU | 671 | GGACAGCCGUGGACAAUGGUU | 2174 |
| D-1667 | 263-281 | 263-281 | CAUUGUCCACGGCUGUCCGUU | 672 | CGGACAGCCGUGGACAAUGUU | 2175 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1668 | 264-282 | 264-282 | AUUGUCCACGGCUGUCCGCUU | 673 | GCGGACAGCCGUGGACAAUUU | 2176 |
| D-1669 | 26-44 | 26-44 | GUGACUGGCAUGUGUGGGGUU | 674 | CCCCACACAUGCCAGUCACUU | 2177 |
| D-1670 | 265-283 | 265-283 | UUGUCCACGGCUGUCCGCCUU | 675 | GGCGGACAGCCGUGGACAAUU | 2178 |
| D-1671 | 266-284 | 266-284 | UGUCCACGGCUGUCCGCCCUU | 676 | GGGCGGACAGCCGUGGACAUU | 2179 |
| D-1672 | 267-285 | 267-285 | GUCCACGGCUGUCCGCCCAUU | 677 | UGGGCGGACAGCCGUGGACUU | 2180 |
| D-1673 | 268-286 | 268-286 | UCCACGGCUGUCCGCCCACUU | 678 | GUGGGCGGACAGCCGUGGAUU | 2181 |
| D-1674 | 269-287 | 269-287 | CCACGGCUGUCCGCCCACCUU | 679 | GGUGGGCGGACAGCCGUGGUU | 2182 |
| D-1675 | 270-288 | 270-288 | CACGGCUGUCCGCCCACCCUU | 680 | GGGUGGGCGGACAGCCGUGUU | 2183 |
| D-1676 | 271-289 | 271-289 | ACGGCUGUCCGCCCACCCCUU | 681 | GGGGUGGGCGGACAGCCGUUU | 2184 |
| D-1677 | 272-290 | 272-290 | CGGCUGUCCGCCCACCCCCUU | 682 | GGGGGUGGGCGGACAGCCGUU | 2185 |
| D-1678 | 273-291 | 273-291 | GGCUGUCCGCCCACCCCCAUU | 683 | UGGGGGUGGGCGGACAGCCUU | 2186 |
| D-1679 | 274-292 | 274-292 | GCUGUCCGCCCACCCCCAUUU | 684 | AUGGGGGUGGGCGGACAGCUU | 2187 |
| D-1680 | 27-45 | 27-45 | UGACUGGCAUGUGUGGGGGUU | 685 | CCCCCACACAUGCCAGUCAUU | 2188 |
| D-1681 | 275-293 | 275-293 | CUGUCCGCCCACCCCCAUUUU | 686 | AAUGGGGGUGGGCGGACAGUU | 2189 |
| D-1682 | 276-294 | 276-294 | UGUCCGCCCACCCCCAUUCUU | 687 | GAAUGGGGGUGGGCGGACAUU | 2190 |
| D-1683 | 277-295 | 277-295 | GUCCGCCCACCCCCAUUCUUU | 688 | AGAAUGGGGGUGGGCGGACUU | 2191 |
| D-1684 | 278-296 | 278-296 | UCCGCCCACCCCCAUUCUCUU | 689 | GAGAAUGGGGGUGGGCGGAUU | 2192 |
| D-1685 | 279-297 | 279-297 | CCGCCCACCCCCAUUCUCCUU | 690 | GGAGAAUGGGGGUGGGCGGUU | 2193 |
| D-1686 | 280-298 | 280-298 | CGCCCACCCCCAUUCUCCAUU | 691 | UGGAGAAUGGGGGUGGGCGUU | 2194 |
| D-1687 | 281-299 | 281-299 | GCCCACCCCCAUUCUCCAAUU | 692 | UUGGAGAAUGGGGGUGGGCUU | 2195 |
| D-1688 | 282-300 | 282-300 | CCCACCCCCAUUCUCCAAGUU | 693 | CUUGGAGAAUGGGGGUGGGUU | 2196 |
| D-1689 | 283-301 | 283-301 | CCACCCCCAUUCUCCAAGCUU | 694 | GCUUGGAGAAUGGGGGUGGUU | 2197 |
| D-1690 | 284-302 | 284-302 | CACCCCCAUUCUCCAAGCUUU | 695 | AGCUUGGAGAAUGGGGGUGUU | 2198 |
| D-1691 | 28-46 | 28-46 | GACUGGCAUGUGUGGGGGCUU | 696 | GCCCCCACACAUGCCAGUCUU | 2199 |
| D-1692 | 285-303 | 285-303 | ACCCCCAUUCUCCAAGCUUUU | 697 | AAGCUUGGAGAAUGGGGGUUU | 2200 |
| D-1693 | 286-304 | 286-304 | CCCCCAUUCUCCAAGCUUCUU | 698 | GAAGCUUGGAGAAUGGGGGUU | 2201 |
| D-1694 | 287-305 | 287-305 | CCCCAUUCUCCAAGCUUCAUU | 699 | UGAAGCUUGGAGAAUGGGGUU | 2202 |
| D-1695 | 288-306 | 288-306 | CCCAUUCUCCAAGCUUCAGUU | 700 | CUGAAGCUUGGAGAAUGGGUU | 2203 |
| D-1696 | 289-307 | 289-307 | CCAUUCUCCAAGCUUCAGCUU | 701 | GCUGAAGCUUGGAGAAUGGUU | 2204 |
| D-1697 | 290-308 | 290-308 | CAUUCUCCAAGCUUCAGCCUU | 702 | GGCUGAAGCUUGGAGAAUGUU | 2205 |
| D-1698 | 291-309 | 291-309 | AUUCUCCAAGCUUCAGCCCUU | 703 | GGGCUGAAGCUUGGAGAAUUU | 2206 |
| D-1699 | 292-310 | 292-310 | UUCUCCAAGCUUCAGCCCCUU | 704 | GGGGCUGAAGCUUGGAGAAUU | 2207 |
| D-1700 | 293-311 | 293-311 | UCUCCAAGCUUCAGCCCCCUU | 705 | GGGGGCUGAAGCUUGGAGAUU | 2208 |
| D-1701 | 294-312 | 294-312 | CUCCAAGCUUCAGCCCCCUUU | 706 | AGGGGGCUGAAGCUUGGAGUU | 2209 |
| D-1702 | 29-47 | 29-47 | ACUGGCAUGUGUGGGGGCAUU | 707 | UGCCCCCACACAUGCCAGUUU | 2210 |
| D-1703 | 295-313 | 295-313 | UCCAAGCUUCAGCCCCCUCUU | 708 | GAGGGGGCUGAAGCUUGGAUU | 2211 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1704 | 296-314 | 296-314 | CCAAGCUUCAGCCCCCUCCUU | 709 | GGAGGGGGCUGAAGCUUGGUU | 2212 |
| D-1705 | 297-315 | 297-315 | CAAGCUUCAGCCCCCUCCUUU | 710 | AGGAGGGGGCUGAAGCUUGUU | 2213 |
| D-1706 | 298-316 | 298-316 | AAGCUUCAGCCCCCUCCUUUU | 711 | AAGGAGGGGGCUGAAGCUUUU | 2214 |
| D-1707 | 299-317 | 299-317 | AGCUUCAGCCCCCUCCUUAUU | 712 | UAAGGAGGGGGCUGAAGCUUU | 2215 |
| D-1708 | 300-318 | 300-318 | GCUUCAGCCCCCUCCUUAGUU | 713 | CUAAGGAGGGGGCUGAAGCUU | 2216 |
| D-1709 | 301-319 | 301-319 | CUUCAGCCCCCUCCUUAGUUU | 714 | ACUAAGGAGGGGGCUGAAGUU | 2217 |
| D-1710 | 302-320 | 302-320 | UUCAGCCCCCUCCUUAGUUUU | 715 | AACUAAGGAGGGGGCUGAAUU | 2218 |
| D-1711 | 303-321 | 303-321 | UCAGCCCCCUCCUUAGUUCUU | 716 | GAACUAAGGAGGGGGCUGAUU | 2219 |
| D-1712 | 304-322 | 304-322 | CAGCCCCCUCCUUAGUUCGUU | 717 | CGAACUAAGGAGGGGGCUGUU | 2220 |
| D-1713 | 30-48 | 30-48 | CUGGCAUGUGUGGGGGCAAUU | 718 | UUGCCCCCACACAUGCCAGUU | 2221 |
| D-1714 | 305-323 | 305-323 | AGCCCCCUCCUUAGUUCGGUU | 719 | CCGAACUAAGGAGGGGGCUUU | 2222 |
| D-1715 | 306-324 | 306-324 | GCCCCCUCCUUAGUUCGGCUU | 720 | GCCGAACUAAGGAGGGGGCUU | 2223 |
| D-1716 | 307-325 | 307-325 | CCCCCUCCUUAGUUCGGCAUU | 721 | UGCCGAACUAAGGAGGGGGUU | 2224 |
| D-1717 | 308-326 | 308-326 | CCCCUCCUUAGUUCGGCAUUU | 722 | AUGCCGAACUAAGGAGGGGUU | 2225 |
| D-1718 | 309-327 | 309-327 | CCCUCCUUAGUUCGGCAUCUU | 723 | GAUGCCGAACUAAGGAGGGUU | 2226 |
| D-1719 | 310-328 | 310-328 | CCUCCUUAGUUCGGCAUCUUU | 724 | AGAUGCCGAACUAAGGAGGUU | 2227 |
| D-1720 | 311-329 | 311-329 | CUCCUUAGUUCGGCAUCUGUU | 725 | CAGAUGCCGAACUAAGGAGUU | 2228 |
| D-1721 | 312-330 | 312-330 | UCCUUAGUUCGGCAUCUGCUU | 726 | GCAGAUGCCGAACUAAGGAUU | 2229 |
| D-1722 | 313-331 | 313-331 | CCUUAGUUCGGCAUCUGCAUU | 727 | UGCAGAUGCCGAACUAAGGUU | 2230 |
| D-1723 | 314-332 | 314-332 | CUUAGUUCGGCAUCUGCACUU | 728 | GUGCAGAUGCCGAACUAAGUU | 2231 |
| D-1724 | 31-49 | 31-49 | UGGCAUGUGUGGGGGCAACUU | 729 | GUUGCCCCCACACAUGCCAUU | 2232 |
| D-1725 | 315-333 | 315-333 | UUAGUUCGGCAUCUGCACAUU | 730 | UGUGCAGAUGCCGAACUAAUU | 2233 |
| D-1726 | 316-334 | 316-334 | UAGUUCGGCAUCUGCACAGUU | 731 | CUGUGCAGAUGCCGAACUAUU | 2234 |
| D-1727 | 317-335 | 317-335 | AGUUCGGCAUCUGCACAGCUU | 732 | GCUGUGCAGAUGCCGAACUUU | 2235 |
| D-1728 | 318-336 | 318-336 | GUUCGGCAUCUGCACAGCAUU | 733 | UGCUGUGCAGAUGCCGAACUU | 2236 |
| D-1729 | 319-337 | 319-337 | UUCGGCAUCUGCACAGCACUU | 734 | GUGCUGUGCAGAUGCCGAAUU | 2237 |
| D-1730 | 320-338 | 320-338 | UCGGCAUCUGCACAGCACUUU | 735 | AGUGCUGUGCAGAUGCCGAUU | 2238 |
| D-1731 | 3-21 | 3-21 | CAAACGGUGCACGGAAGAGUU | 736 | CUCUUCCGUGCACCGUUUGUU | 2239 |
| D-1732 | 321-339 | 321-339 | CGGCAUCUGCACAGCACUGUU | 737 | CAGUGCUGUGCAGAUGCCGUU | 2240 |
| D-1733 | 322-340 | 322-340 | GGCAUCUGCACAGCACUGAUU | 738 | UCAGUGCUGUGCAGAUGCCUU | 2241 |
| D-1734 | 323-341 | 323-341 | GCAUCUGCACAGCACUGAAUU | 739 | UUCAGUGCUGUGCAGAUGCUU | 2242 |
| D-1735 | 324-342 | 324-342 | CAUCUGCACAGCACUGAAGUU | 740 | CUUCAGUGCUGUGCAGAUGUU | 2243 |
| D-1736 | 32-50 | 32-50 | GGCAUGUGUGGGGGCAACAUU | 741 | UGUUGCCCCCACACAUGCCUU | 2244 |
| D-1737 | 325-343 | 325-343 | AUCUGCACAGCACUGAAGAUU | 742 | UCUUCAGUGCUGUGCAGAUUU | 2245 |
| D-1738 | 326-344 | 326-344 | UCUGCACAGCACUGAAGAAUU | 743 | UUCUUCAGUGCUGUGCAGAUU | 2246 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1739 | 327-345 | 327-345 | CUGCACAGCACUGAAGAACUU | 744 | GUUCUUCAGUGCUGUGCAGUU | 2247 |
| D-1740 | 328-346 | 328-346 | UGCACAGCACUGAAGAACCUU | 745 | GGUUCUUCAGUGCUGUGCAUU | 2248 |
| D-1741 | 329-347 | 329-347 | GCACAGCACUGAAGAACCUUU | 746 | AGGUUCUUCAGUGCUGUGCUU | 2249 |
| D-1742 | 330-348 | 330-348 | CACAGCACUGAAGAACCUGUU | 747 | CAGGUUCUUCAGUGCUGUGUU | 2250 |
| D-1743 | 331-349 | 331-349 | ACAGCACUGAAGAACCUGGUU | 748 | CCAGGUUCUUCAGUGCUGUUU | 2251 |
| D-1744 | 332-350 | 332-350 | CAGCACUGAAGAACCUGGGUU | 749 | CCCAGGUUCUUCAGUGCUGUU | 2252 |
| D-1745 | 333-351 | 333-351 | AGCACUGAAGAACCUGGGAUU | 750 | UCCCAGGUUCUUCAGUGCUUU | 2253 |
| D-1746 | 334-352 | 334-352 | GCACUGAAGAACCUGGGAAUU | 751 | UUCCCAGGUUCUUCAGUGCUU | 2254 |
| D-1747 | 33-51 | 33-51 | GCAUGUGUGGGGGCAACACUU | 752 | GUGUUGCCCCCACACAUGCUU | 2255 |
| D-1748 | 335-353 | 335-353 | CACUGAAGAACCUGGGAAUUU | 753 | AUUCCCAGGUUCUUCAGUGUU | 2256 |
| D-1749 | 336-354 | 336-354 | ACUGAAGAACCUGGGAAUCUU | 754 | GAUUCCCAGGUUCUUCAGUUU | 2257 |
| D-1750 | 337-355 | 337-355 | CUGAAGAACCUGGGAAUCAUU | 755 | UGAUUCCCAGGUUCUUCAGUU | 2258 |
| D-1751 | 338-356 | 338-356 | UGAAGAACCUGGGAAUCAGUU | 756 | CUGAUUCCCAGGUUCUUCAUU | 2259 |
| D-1752 | 339-357 | 339-357 | GAAGAACCUGGGAAUCAGAUU | 757 | UCUGAUUCCCAGGUUCUUCUU | 2260 |
| D-1753 | 340-358 | 340-358 | AAGAACCUGGGAAUCAGACUU | 758 | GUCUGAUUCCCAGGUUCUUUU | 2261 |
| D-1754 | 341-359 | 341-359 | AGAACCUGGGAAUCAGACCUU | 759 | GGUCUGAUUCCCAGGUUCUUU | 2262 |
| D-1755 | 342-360 | 342-360 | GAACCUGGGAAUCAGACCCUU | 760 | GGGUCUGAUUCCCAGGUUCUU | 2263 |
| D-1756 | 343-361 | 343-361 | AACCUGGGAAUCAGACCCUUU | 761 | AGGGUCUGAUUCCCAGGUUUU | 2264 |
| D-1757 | 344-362 | 344-362 | ACCUGGGAAUCAGACCCUGUU | 762 | CAGGGUCUGAUUCCCAGGUUU | 2265 |
| D-1758 | 34-52 | 34-52 | CAUGUGUGGGGGCAACACGUU | 763 | CGUGUUGCCCCCACACAUGUU | 2266 |
| D-1759 | 345-363 | 345-363 | CCUGGGAAUCAGACCCUGAUU | 764 | UCAGGGUCUGAUUCCCAGGUU | 2267 |
| D-1760 | 346-364 | 346-364 | CUGGGAAUCAGACCCUGAGUU | 765 | CUCAGGGUCUGAUUCCCAGUU | 2268 |
| D-1761 | 347-365 | 347-365 | UGGGAAUCAGACCCUGAGAUU | 766 | UCUCAGGGUCUGAUUCCCAUU | 2269 |
| D-1762 | 348-366 | 348-366 | GGGAAUCAGACCCUGAGACUU | 767 | GUCUCAGGGUCUGAUUCCCUU | 2270 |
| D-1763 | 349-367 | 349-367 | GGAAUCAGACCCUGAGACCUU | 768 | GGUCUCAGGGUCUGAUUCCUU | 2271 |
| D-1764 | 350-368 | 350-368 | GAAUCAGACCCUGAGACCCUU | 769 | GGGUCUCAGGGUCUGAUUCUU | 2272 |
| D-1765 | 351-369 | 351-369 | AAUCAGACCCUGAGACCCUUU | 770 | AGGGUCUCAGGGUCUGAUUUU | 2273 |
| D-1766 | 352-370 | 352-370 | AUCAGACCCUGAGACCCUGUU | 771 | CAGGGUCUCAGGGUCUGAUUU | 2274 |
| D-1767 | 353-371 | 353-371 | UCAGACCCUGAGACCCUGAUU | 772 | UCAGGGUCUCAGGGUCUGAUU | 2275 |
| D-1768 | 354-372 | 354-372 | CAGACCCUGAGACCCUGAGUU | 773 | CUCAGGGUCUCAGGGUCUGUU | 2276 |
| D-1769 | 35-53 | 35-53 | AUGUGUGGGGGCAACACGAUU | 774 | UCGUGUUGCCCCCACACAUUU | 2277 |
| D-1770 | 355-373 | 355-373 | AGACCCUGAGACCCUGAGCUU | 775 | GCUCAGGGUCUCAGGGUCUUU | 2278 |
| D-1771 | 356-374 | 356-374 | GACCCUGAGACCCUGAGCAUU | 776 | UGCUCAGGGUCUCAGGGUCUU | 2279 |
| D-1772 | 357-375 | 357-375 | ACCCUGAGACCCUGAGCAAUU | 777 | UUGCUCAGGGUCUCAGGGUUU | 2280 |
| D-1773 | 358-376 | 358-376 | CCCUGAGACCCUGAGCAAUUU | 778 | AUUGCUCAGGGUCUCAGGGUU | 2281 |
| D-1774 | 359-377 | 359-377 | CCUGAGACCCUGAGCAAUCUU | 779 | GAUUGCUCAGGGUCUCAGGUU | 2282 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1775 | 360-378 | 360-378 | CUGAGACCCUGAGCAAUCCUU | 780 | GGAUUGCUCAGGGUCUCAGUU | 2283 |
| D-1776 | 361-379 | 361-379 | UGAGACCCUGAGCAAUCCCUU | 781 | GGGAUUGCUCAGGGUCUCAUU | 2284 |
| D-1777 | 362-380 | 362-380 | GAGACCCUGAGCAAUCCCAUU | 782 | UGGGAUUGCUCAGGGUCUCUU | 2285 |
| D-1778 | 363-381 | 363-381 | AGACCCUGAGCAAUCCCAGUU | 783 | CUGGGAUUGCUCAGGGUCUUU | 2286 |
| D-1779 | 364-382 | 364-382 | GACCCUGAGCAAUCCCAGGUU | 784 | CCUGGGAUUGCUCAGGGUCUU | 2287 |
| D-1780 | 365-383 | 365-383 | ACCCUGAGCAAUCCCAGGUUU | 785 | ACCUGGGAUUGCUCAGGGUUU | 2288 |
| D-1781 | 36-54 | 36-54 | UGUGUGGGGGCAACACGAUUU | 786 | AUCGUGUUGCCCCCACACAUU | 2289 |
| D-1782 | 366-384 | 366-384 | CCCUGAGCAAUCCCAGGUCUU | 787 | GACCUGGGAUUGCUCAGGGUU | 2290 |
| D-1783 | 367-385 | 367-385 | CCUGAGCAAUCCCAGGUCCUU | 788 | GGACCUGGGAUUGCUCAGGUU | 2291 |
| D-1784 | 368-386 | 368-386 | CUGAGCAAUCCCAGGUCCAUU | 789 | UGGACCUGGGAUUGCUCAGUU | 2292 |
| D-1785 | 369-387 | 369-387 | UGAGCAAUCCCAGGUCCAGUU | 790 | CUGGACCUGGGAUUGCUCAUU | 2293 |
| D-1786 | 370-388 | 370-388 | GAGCAAUCCCAGGUCCAGCUU | 791 | GCUGGACCUGGGAUUGCUCUU | 2294 |
| D-1787 | 371-389 | 371-389 | AGCAAUCCCAGGUCCAGCGUU | 792 | CGCUGGACCUGGGAUUGCUUU | 2295 |
| D-1788 | 372-390 | 372-390 | GCAAUCCCAGGUCCAGCGCUU | 793 | GCGCUGGACCUGGGAUUGCUU | 2296 |
| D-1789 | 373-391 | 373-391 | CAAUCCCAGGUCCAGCGCCUU | 794 | GGCGCUGGACCUGGGAUUGUU | 2297 |
| D-1790 | 374-392 | 374-392 | AAUCCCAGGUCCAGCGCCAUU | 795 | UGGCGCUGGACCUGGGAUUUU | 2298 |
| D-1791 | 375-393 | 375-393 | AUCCCAGGUCCAGCGCCAGUU | 796 | CUGGCGCUGGACCUGGGAUUU | 2299 |
| D-1792 | 37-55 | 37-55 | GUGUGGGGGCAACACGAUUUU | 797 | AAUCGUGUUGCCCCCACACUU | 2300 |
| D-1793 | 376-394 | 376-394 | UCCCAGGUCCAGCGCCAGCUU | 798 | GCUGGCGCUGGACCUGGGAUU | 2301 |
| D-1794 | 377-395 | 377-395 | CCCAGGUCCAGCGCCAGCCUU | 799 | GGCUGGCGCUGGACCUGGGUU | 2302 |
| D-1795 | 378-396 | 378-396 | CCAGGUCCAGCGCCAGCCCUU | 800 | GGGCUGGCGCUGGACCUGGUU | 2303 |
| D-1796 | 379-397 | 379-397 | CAGGUCCAGCGCCAGCCCUUU | 801 | AGGGCUGGCGCUGGACCUGUU | 2304 |
| D-1797 | 380-398 | 380-398 | AGGUCCAGCGCCAGCCCUAUU | 802 | UAGGGCUGGCGCUGGACCUUU | 2305 |
| D-1798 | 381-399 | 381-399 | GGUCCAGCGCCAGCCCUAUUU | 803 | AUAGGGCUGGCGCUGGACCUU | 2306 |
| D-1799 | 382-400 | 382-400 | GUCCAGCGCCAGCCCUAUCUU | 804 | GAUAGGGCUGGCGCUGGACUU | 2307 |
| D-1800 | 383-401 | 383-401 | UCCAGCGCCAGCCCUAUCAUU | 805 | UGAUAGGGCUGGCGCUGGAUU | 2308 |
| D-1801 | 384-402 | 384-402 | CCAGCGCCAGCCCUAUCAUUU | 806 | AUGAUAGGGCUGGCGCUGGUU | 2309 |
| D-1802 | 385-403 | 385-403 | CAGCGCCAGCCCUAUCAUGUU | 807 | CAUGAUAGGGCUGGCGCUGUU | 2310 |
| D-1803 | 38-56 | 38-56 | UGUGGGGGCAACACGAUUCUU | 808 | GAAUCGUGUUGCCCCCACAUU | 2311 |
| D-1804 | 386-404 | 386-404 | AGCGCCAGCCCUAUCAUGAUU | 809 | UCAUGAUAGGGCUGGCGCUUU | 2312 |
| D-1805 | 387-405 | 387-405 | GCGCCAGCCCUAUCAUGACUU | 810 | GUCAUGAUAGGGCUGGCGCUU | 2313 |
| D-1806 | 388-406 | 388-406 | CGCCAGCCCUAUCAUGACCUU | 811 | GGUCAUGAUAGGGCUGGCGUU | 2314 |
| D-1807 | 389-407 | 389-407 | GCCAGCCCUAUCAUGACCAUU | 812 | UGGUCAUGAUAGGGCUGGCUU | 2315 |
| D-1808 | 390-408 | 390-408 | CCAGCCCUAUCAUGACCAAUU | 813 | UUGGUCAUGAUAGGGCUGGUU | 2316 |
| D-1809 | 391-409 | 391-409 | CAGCCCUAUCAUGACCAAGUU | 814 | CUUGGUCAUGAUAGGGCUGUU | 2317 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1810 | 392-410 | 392-410 | AGCCCUAUCAUGACCAAGGUU | 815 | CCUUGGUCAUGAUAGGGCUUU | 2318 |
| D-1811 | 393-411 | 393-411 | GCCCUAUCAUGACCAAGGAUU | 816 | UCCUUGGUCAUGAUAGGGCUU | 2319 |
| D-1812 | 394-412 | 394-412 | CCCUAUCAUGACCAAGGAGUU | 817 | CUCCUUGGUCAUGAUAGGGUU | 2320 |
| D-1813 | 395-413 | 395-413 | CCUAUCAUGACCAAGGAGUUU | 818 | ACUCCUUGGUCAUGAUAGGUU | 2321 |
| D-1814 | 39-57 | 39-57 | GUGGGGGCAACACGAUUCUUU | 819 | AGAAUCGUGUUGCCCCCACUU | 2322 |
| D-1815 | 396-414 | 396-414 | CUAUCAUGACCAAGGAGUAUU | 820 | UACUCCUUGGUCAUGAUAGUU | 2323 |
| D-1816 | 397-415 | 397-415 | UAUCAUGACCAAGGAGUAUUU | 821 | AUACUCCUUGGUCAUGAUAUU | 2324 |
| D-1817 | 398-416 | 398-416 | AUCAUGACCAAGGAGUAUCUU | 822 | GAUACUCCUUGGUCAUGAUUU | 2325 |
| D-1818 | 399-417 | 399-417 | UCAUGACCAAGGAGUAUCAUU | 823 | UGAUACUCCUUGGUCAUGAUU | 2326 |
| D-1819 | 400-418 | 400-418 | CAUGACCAAGGAGUAUCAAUU | 824 | UUGAUACUCCUUGGUCAUGUU | 2327 |
| D-1820 | 401-419 | 401-419 | AUGACCAAGGAGUAUCAAGUU | 825 | CUUGAUACUCCUUGGUCAUUU | 2328 |
| D-1821 | 402-420 | 402-420 | UGACCAAGGAGUAUCAAGAUU | 826 | UCUUGAUACUCCUUGGUCAUU | 2329 |
| D-1822 | 403-421 | 403-421 | GACCAAGGAGUAUCAAGACUU | 827 | GUCUUGAUACUCCUUGGUCUU | 2330 |
| D-1823 | 404-422 | 404-422 | ACCAAGGAGUAUCAAGACCUU | 828 | GGUCUUGAUACUCCUUGGUUU | 2331 |
| D-1824 | 405-423 | 405-423 | CCAAGGAGUAUCAAGACCUUU | 829 | AGGUCUUGAUACUCCUUGGUU | 2332 |
| D-1825 | 40-58 | 40-58 | UGGGGGCAACACGAUUCUCUU | 830 | GAGAAUCGUGUUGCCCCCAUU | 2333 |
| D-1826 | 406-424 | 406-424 | CAAGGAGUAUCAAGACCUUUU | 831 | AAGGUCUUGAUACUCCUUGUU | 2334 |
| D-1827 | 407-425 | 407-425 | AAGGAGUAUCAAGACCUUCUU | 832 | GAAGGUCUUGAUACUCCUUUU | 2335 |
| D-1828 | 408-426 | 408-426 | AGGAGUAUCAAGACCUUCAUU | 833 | UGAAGGUCUUGAUACUCCUUU | 2336 |
| D-1829 | 409-427 | 409-427 | GGAGUAUCAAGACCUUCAGUU | 834 | CUGAAGGUCUUGAUACUCCUU | 2337 |
| D-1830 | 410-428 | 410-428 | GAGUAUCAAGACCUUCAGCUU | 835 | GCUGAAGGUCUUGAUACUCUU | 2338 |
| D-1831 | 411-429 | 411-429 | AGUAUCAAGACCUUCAGCAUU | 836 | UGCUGAAGGUCUUGAUACUUU | 2339 |
| D-1832 | 412-430 | 412-430 | GUAUCAAGACCUUCAGCAUUU | 837 | AUGCUGAAGGUCUUGAUACUU | 2340 |
| D-1833 | 413-431 | 413-431 | UAUCAAGACCUUCAGCAUCUU | 838 | GAUGCUGAAGGUCUUGAUAUU | 2341 |
| D-1834 | 414-432 | 414-432 | AUCAAGACCUUCAGCAUCUUU | 839 | AGAUGCUGAAGGUCUUGAUUU | 2342 |
| D-1835 | 415-433 | 415-433 | UCAAGACCUUCAGCAUCUGUU | 840 | CAGAUGCUGAAGGUCUUGAUU | 2343 |
| D-1836 | 41-59 | 41-59 | GGGGGCAACACGAUUCUCCUU | 841 | GGAGAAUCGUGUUGCCCCCUU | 2344 |
| D-1837 | 416-434 | 416-434 | CAAGACCUUCAGCAUCUGGUU | 842 | CCAGAUGCUGAAGGUCUUGUU | 2345 |
| D-1838 | 417-435 | 417-435 | AAGACCUUCAGCAUCUGGAUU | 843 | UCCAGAUGCUGAAGGUCUUUU | 2346 |
| D-1839 | 418-436 | 418-436 | AGACCUUCAGCAUCUGGACUU | 844 | GUCCAGAUGCUGAAGGUCUUU | 2347 |
| D-1840 | 419-437 | 419-437 | GACCUUCAGCAUCUGGACAUU | 845 | UGUCCAGAUGCUGAAGGUCUU | 2348 |
| D-1841 | 420-438 | 420-438 | ACCUUCAGCAUCUGGACAAUU | 846 | UUGUCCAGAUGCUGAAGGUUU | 2349 |
| D-1842 | 421-439 | 421-439 | CCUUCAGCAUCUGGACAAUUU | 847 | AUUGUCCAGAUGCUGAAGGUU | 2350 |
| D-1843 | 4-22 | 4-22 | AAACGGUGCACGGAAGAGUUU | 848 | ACUCUUCCGUGCACCGUUUUU | 2351 |
| D-1844 | 422-440 | 422-440 | CUUCAGCAUCUGGACAAUGUU | 849 | CAUUGUCCAGAUGCUGAAGUU | 2352 |
| D-1845 | 423-441 | 423-441 | UUCAGCAUCUGGACAAUGAUU | 850 | UCAUUGUCCAGAUGCUGAAUU | 2353 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1846 | 424-442 | 424-442 | UCAGCAUCUGGACAAUGAGUU | 851 | CUCAUUGUCCAGAUGCUGAUU | 2354 |
| D-1847 | 425-443 | 425-443 | CAGCAUCUGGACAAUGAGGUU | 852 | CCUCAUUGUCCAGAUGCUGUU | 2355 |
| D-1848 | 42-60 | 42-60 | GGGGCAACACGAUUCUCCUUU | 853 | AGGAGAAUCGUGUUGCCCCUU | 2356 |
| D-1849 | 426-444 | 426-444 | AGCAUCUGGACAAUGAGGAUU | 854 | UCCUCAUUGUCCAGAUGCUUU | 2357 |
| D-1850 | 427-445 | 427-445 | GCAUCUGGACAAUGAGGAGUU | 855 | CUCCUCAUUGUCCAGAUGCUU | 2358 |
| D-1851 | 428-446 | 428-446 | CAUCUGGACAAUGAGGAGAUU | 856 | UCUCCUCAUUGUCCAGAUGUU | 2359 |
| D-1852 | 429-447 | 429-447 | AUCUGGACAAUGAGGAGAGUU | 857 | CUCUCCUCAUUGUCCAGAUUU | 2360 |
| D-1853 | 430-448 | 430-448 | UCUGGACAAUGAGGAGAGUUU | 858 | ACUCUCCUCAUUGUCCAGAUU | 2361 |
| D-1854 | 431-449 | 431-449 | CUGGACAAUGAGGAGAGUGUU | 859 | CACUCUCCUCAUUGUCCAGUU | 2362 |
| D-1855 | 432-450 | 432-450 | UGGACAAUGAGGAGAGUGAUU | 860 | UCACUCUCCUCAUUGUCCAUU | 2363 |
| D-1856 | 433-451 | 433-451 | GGACAAUGAGGAGAGUGACUU | 861 | GUCACUCUCCUCAUUGUCCUU | 2364 |
| D-1857 | 434-452 | 434-452 | GACAAUGAGGAGAGUGACCUU | 862 | GGUCACUCUCCUCAUUGUCUU | 2365 |
| D-1858 | 435-453 | 435-453 | ACAAUGAGGAGAGUGACCAUU | 863 | UGGUCACUCUCCUCAUUGUUU | 2366 |
| D-1859 | 43-61 | 43-61 | GGGCAACACGAUUCUCCUCUU | 864 | GAGGAGAAUCGUGUUGCCCUU | 2367 |
| D-1860 | 436-454 | 436-454 | CAAUGAGGAGAGUGACCACUU | 865 | GUGGUCACUCUCCUCAUUGUU | 2368 |
| D-1861 | 437-455 | 437-455 | AAUGAGGAGAGUGACCACCUU | 866 | GGUGGUCACUCUCCUCAUUUU | 2369 |
| D-1862 | 438-456 | 438-456 | AUGAGGAGAGUGACCACCAUU | 867 | UGGUGGUCACUCUCCUCAUUU | 2370 |
| D-1863 | 439-457 | 439-457 | UGAGGAGAGUGACCACCAUUU | 868 | AUGGUGGUCACUCUCCUCAUU | 2371 |
| D-1864 | 440-458 | 440-458 | GAGGAGAGUGACCACCAUCUU | 869 | GAUGGUGGUCACUCUCCUCUU | 2372 |
| D-1865 | 441-459 | 441-459 | AGGAGAGUGACCACCAUCAUU | 870 | UGAUGGUGGUCACUCUCCUUU | 2373 |
| D-1866 | 442-460 | 442-460 | GGAGAGUGACCACCAUCAGUU | 871 | CUGAUGGUGGUCACUCUCCUU | 2374 |
| D-1867 | 443-461 | 443-461 | GAGAGUGACCACCAUCAGCUU | 872 | GCUGAUGGUGGUCACUCUCUU | 2375 |
| D-1868 | 444-462 | 444-462 | AGAGUGACCACCAUCAGCUUU | 873 | AGCUGAUGGUGGUCACUCUUU | 2376 |
| D-1869 | 445-463 | 445-463 | GAGUGACCACCAUCAGCUCUU | 874 | GAGCUGAUGGUGGUCACUCUU | 2377 |
| D-1870 | 44-62 | 44-62 | GGCAACACGAUUCUCCUCCUU | 875 | GGAGGAGAAUCGUGUUGCCUU | 2378 |
| D-1871 | 446-464 | 446-464 | AGUGACCACCAUCAGCUCAUU | 876 | UGAGCUGAUGGUGGUCACUUU | 2379 |
| D-1872 | 447-465 | 447-465 | GUGACCACCAUCAGCUCAGUU | 877 | CUGAGCUGAUGGUGGUCACUU | 2380 |
| D-1873 | 448-466 | 448-466 | UGACCACCAUCAGCUCAGAUU | 878 | UCUGAGCUGAUGGUGGUCAUU | 2381 |
| D-1874 | 449-467 | 449-467 | GACCACCAUCAGCUCAGAAUU | 879 | UUCUGAGCUGAUGGUGGUCUU | 2382 |
| D-1875 | 450-468 | 450-468 | ACCACCAUCAGCUCAGAAAUU | 880 | UUUCUGAGCUGAUGGUGGUUU | 2383 |
| D-1876 | 451-469 | 451-469 | CCACCAUCAGCUCAGAAAAUU | 881 | UUUUCUGAGCUGAUGGUGGUU | 2384 |
| D-1877 | 452-470 | 452-470 | CACCAUCAGCUCAGAAAAGUU | 882 | CUUUUCUGAGCUGAUGGUGUU | 2385 |
| D-1878 | 453-471 | — | ACCAUCAGCUCAGAAAAGGUU | 883 | CCUUUUCUGAGCUGAUGGUUU | 2386 |
| D-1879 | 454-472 | — | CCAUCAGCUCAGAAAAGGGUU | 884 | CCCUUUUCUGAGCUGAUGGUU | 2387 |
| D-1880 | 455-473 | — | CAUCAGCUCAGAAAAGGGCUU | 885 | GCCCUUUUCUGAGCUGAUGUU | 2388 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1881 | 45-63 | 45-63 | GCAACACGAUUCUCCUCCCUU | 886 | GGGAGGAGAAUCGUGUUGCUU | 2389 |
| D-1882 | 456-474 | — | AUCAGCUCAGAAAAGGGCCUU | 887 | GGCCCUUUUCUGAGCUGAUUU | 2390 |
| D-1883 | 457-475 | — | UCAGCUCAGAAAAGGGCCAUU | 888 | UGGCCCUUUUCUGAGCUGAUU | 2391 |
| D-1884 | 458-476 | — | CAGCUCAGAAAAGGGCCACUU | 889 | GUGGCCCUUUUCUGAGCUGUU | 2392 |
| D-1885 | 459-477 | — | AGCUCAGAAAAGGGCCACCUU | 890 | GGUGGCCCUUUUCUGAGCUUU | 2393 |
| D-1886 | 460-478 | — | GCUCAGAAAAGGGCCACCUUU | 891 | AGGUGGCCCUUUUCUGAGCUU | 2394 |
| D-1887 | 461-479 | — | CUCAGAAAAGGGCCACCUCUU | 892 | GAGGUGGCCCUUUUCUGAGUU | 2395 |
| D-1888 | 462-480 | — | UCAGAAAAGGGCCACCUCCUU | 893 | GGAGGUGGCCCUUUUCUGAUU | 2396 |
| D-1889 | 463-481 | — | CAGAAAAGGGCCACCUCCUUU | 894 | AGGAGGUGGCCCUUUUCUGUU | 2397 |
| D-1890 | 464-482 | — | AGAAAAGGGCCACCUCCUCUU | 895 | GAGGAGGUGGCCCUUUUCUUU | 2398 |
| D-1891 | 465-483 | — | GAAAAGGGCCACCUCCUCCUU | 896 | GGAGGAGGUGGCCCUUUUCUU | 2399 |
| D-1892 | 46-64 | 46-64 | CAACACGAUUCUCCUCCCUUU | 897 | AGGGAGGAGAAUCGUGUUGUU | 2400 |
| D-1893 | 466-484 | — | AAAAGGGCCACCUCCUCCCUU | 898 | GGGAGGAGGUGGCCCUUUUUU | 2401 |
| D-1894 | 467-485 | — | AAAGGGCCACCUCCUCCCCUU | 899 | GGGGAGGAGGUGGCCCUUUUU | 2402 |
| D-1895 | 468-486 | — | AAGGGCCACCUCCUCCCCAUU | 900 | UGGGGAGGAGGUGGCCCUUUU | 2403 |
| D-1896 | 469-487 | — | AGGGCCACCUCCUCCCCAGUU | 901 | CUGGGGAGGAGGUGGCCCUUU | 2404 |
| D-1897 | 470-488 | — | GGGCCACCUCCUCCCCAGCUU | 902 | GCUGGGGAGGAGGUGGCCCUU | 2405 |
| D-1898 | 471-489 | — | GGCCACCUCCUCCCCAGCCUU | 903 | GGCUGGGGAGGAGGUGGCCUU | 2406 |
| D-1899 | 472-490 | — | GCCACCUCCUCCCCAGCCCUU | 904 | GGGCUGGGGAGGAGGUGGCUU | 2407 |
| D-1900 | 473-491 | — | CCACCUCCUCCCCAGCCCCUU | 905 | GGGGCUGGGGAGGAGGUGGUU | 2408 |
| D-1901 | 474-492 | — | CACCUCCUCCCCAGCCCCUUU | 906 | AGGGGCUGGGGAGGAGGUGUU | 2409 |
| D-1902 | 475-493 | — | ACCUCCUCCCCAGCCCCUCUU | 907 | GAGGGGCUGGGGAGGAGGUUU | 2410 |
| D-1903 | 476-494 | — | CCUCCUCCCCAGCCCCUCCUU | 908 | GGAGGGGCUGGGGAGGAGGUU | 2411 |
| D-1904 | 47-65 | 47-65 | AACACGAUUCUCCUCCCUGUU | 909 | CAGGGAGGAGAAUCGUGUUUU | 2412 |
| D-1905 | 477-495 | — | CUCCUCCCCAGCCCCUCCUUU | 910 | AGGAGGGGCUGGGGAGGAGUU | 2413 |
| D-1906 | 478-496 | — | UCCUCCCCAGCCCCUCCUGUU | 911 | CAGGAGGGGCUGGGGAGGAUU | 2414 |
| D-1907 | 479-497 | — | CCUCCCCAGCCCCUCCUGCUU | 912 | GCAGGAGGGGCUGGGGAGGUU | 2415 |
| D-1908 | 480-498 | — | CUCCCCAGCCCCUCCUGCAUU | 913 | UGCAGGAGGGGCUGGGGAGUU | 2416 |
| D-1909 | 481-499 | — | UCCCCAGCCCCUCCUGCAGUU | 914 | CUGCAGGAGGGGCUGGGGAUU | 2417 |
| D-1910 | 482-500 | — | CCCCAGCCCCUCCUGCAGCUU | 915 | GCUGCAGGAGGGGCUGGGGUU | 2418 |
| D-1911 | 483-501 | — | CCCAGCCCCUCCUGCAGCGUU | 916 | CGCUGCAGGAGGGGCUGGGUU | 2419 |
| D-1912 | 484-502 | — | CCAGCCCCUCCUGCAGCGUUU | 917 | ACGCUGCAGGAGGGGCUGGUU | 2420 |
| D-1913 | 485-503 | — | CAGCCCCUCCUGCAGCGUCUU | 918 | GACGCUGCAGGAGGGGCUGUU | 2421 |
| D-1914 | 486-504 | — | AGCCCCUCCUGCAGCGUCUUU | 919 | AGACGCUGCAGGAGGGGCUUU | 2422 |
| D-1915 | 48-66 | 48-66 | ACACGAUUCUCCUCCCUGGUU | 920 | CCAGGGAGGAGAAUCGUGUUU | 2423 |
| D-1916 | 487-505 | — | GCCCCUCCUGCAGCGUCUCUU | 921 | GAGACGCUGCAGGAGGGGCUU | 2424 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-1917 | 488-506 | — | CCCCUCCUGCAGCGUCUCUUU | 922 | AGAGACGCUGCAGGAGGGGUU | 2425 |
| D-1918 | 489-507 | — | CCCUCCUGCAGCGUCUCUGUU | 923 | CAGAGACGCUGCAGGAGGGUU | 2426 |
| D-1919 | 490-508 | — | CCUCCUGCAGCGUCUCUGCUU | 924 | GCAGAGACGCUGCAGGAGGUU | 2427 |
| D-1920 | 491-509 | — | CUCCUGCAGCGUCUCUGCUUU | 925 | AGCAGAGACGCUGCAGGAGUU | 2428 |
| D-1921 | 492-510 | — | UCCUGCAGCGUCUCUGCUCUU | 926 | GAGCAGAGACGCUGCAGGAUU | 2429 |
| D-1922 | 493-511 | — | CCUGCAGCGUCUCUGCUCCUU | 927 | GGAGCAGAGACGCUGCAGGUU | 2430 |
| D-1923 | 494-512 | — | CUGCAGCGUCUCUGCUCCGUU | 928 | CGGAGCAGAGACGCUGCAGUU | 2431 |
| D-1924 | 495-513 | — | UGCAGCGUCUCUGCUCCGGUU | 929 | CCGGAGCAGAGACGCUGCAUU | 2432 |
| D-1925 | 496-514 | — | GCAGCGUCUCUGCUCCGGAUU | 930 | UCCGGAGCAGAGACGCUGCUU | 2433 |
| D-1926 | 49-67 | 49-67 | CACGAUUCUCCUCCCUGGGUU | 931 | CCCAGGGAGGAGAAUCGUGUU | 2434 |
| D-1927 | 497-515 | — | CAGCGUCUCUGCUCCGGACUU | 932 | GUCCGGAGCAGAGACGCUGUU | 2435 |
| D-1928 | 498-516 | — | AGCGUCUCUGCUCCGGACCUU | 933 | GGUCCGGAGCAGAGACGCUUU | 2436 |
| D-1929 | 499-517 | — | GCGUCUCUGCUCCGGACCUUU | 934 | AGGUCCGGAGCAGAGACGCUU | 2437 |
| D-1930 | 500-518 | — | CGUCUCUGCUCCGGACCUCUU | 935 | GAGGUCCGGAGCAGAGACGUU | 2438 |
| D-1931 | 501-519 | — | GUCUCUGCUCCGGACCUCGUU | 936 | CGAGGUCCGGAGCAGAGACUU | 2439 |
| D-1932 | 502-520 | — | UCUCUGCUCCGGACCUCGCUU | 937 | GCGAGGUCCGGAGCAGAGAUU | 2440 |
| D-1933 | 503-521 | — | CUCUGCUCCGGACCUCGCCUU | 938 | GGCGAGGUCCGGAGCAGAGUU | 2441 |
| D-1934 | 504-522 | — | UCUGCUCCGGACCUCGCCUUU | 939 | AGGCGAGGUCCGGAGCAGAUU | 2442 |
| D-1935 | 505-523 | — | CUGCUCCGGACCUCGCCUCUU | 940 | GAGGCGAGGUCCGGAGCAGUU | 2443 |
| D-1936 | 506-524 | — | UGCUCCGGACCUCGCCUCCUU | 941 | GGAGGCGAGGUCCGGAGCAUU | 2444 |
| D-1937 | 50-68 | 50-68 | ACGAUUCUCCUCCCUGGGGUU | 942 | CCCCAGGGAGGAGAAUCGUUU | 2445 |
| D-1938 | 507-525 | — | GCUCCGGACCUCGCCUCCUUU | 943 | AGGAGGCGAGGUCCGGAGCUU | 2446 |
| D-1939 | 508-526 | — | CUCCGGACCUCGCCUCCUCUU | 944 | GAGGAGGCGAGGUCCGGAGUU | 2447 |
| D-1940 | 509-527 | — | UCCGGACCUCGCCUCCUCCUU | 945 | GGAGGAGGCGAGGUCCGGAUU | 2448 |
| D-1941 | 510-528 | — | CCGGACCUCGCCUCCUCCUUU | 946 | AGGAGGAGGCGAGGUCCGGUU | 2449 |
| D-1942 | 511-529 | — | CGGACCUCGCCUCCUCCUGUU | 947 | CAGGAGGAGGCGAGGUCCGUU | 2450 |
| D-1943 | 512-530 | — | GGACCUCGCCUCCUCCUGCUU | 948 | GCAGGAGGAGGCGAGGUCCUU | 2451 |
| D-1944 | 513-531 | — | GACCUCGCCUCCUCCUGCUUU | 949 | AGCAGGAGGAGGCGAGGUCUU | 2452 |
| D-1945 | 514-532 | — | ACCUCGCCUCCUCCUGCUCUU | 950 | GAGCAGGAGGAGGCGAGGUUU | 2453 |
| D-1946 | 515-533 | — | CCUCGCCUCCUCCUGCUCUUU | 951 | AGAGCAGGAGGAGGCGAGGUU | 2454 |
| D-1947 | 516-534 | — | CUCGCCUCCUCCUGCUCUCUU | 952 | GAGAGCAGGAGGAGGCGAGUU | 2455 |
| D-1948 | 51-69 | 51-69 | CGAUUCUCCUCCCUGGGGAUU | 953 | UCCCCAGGGAGGAGAAUCGUU | 2456 |
| D-1949 | 517-535 | - | UCGCCUCCUCCUGCUCUCCUU | 954 | GGAGAGCAGGAGGAGGCGAUU | 2457 |
| D-1950 | 518-536 | — | CGCCUCCUCCUGCUCUCCCUU | 955 | GGGAGAGCAGGAGGAGGCGUU | 2458 |
| D-1951 | 519-537 | — | GCCUCCUCCUGCUCUCCCUUU | 956 | AGGGAGAGCAGGAGGAGGCUU | 2459 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1952 | 520-538 | — | CCUCCUCCUGCUCUCCCUGUU | 957 | CAGGGAGAGCAGGAGGAGGUU | 2460 |
| D-1953 | 521-539 | — | CUCCUCCUGCUCUCCCUGGUU | 958 | CCAGGGAGAGCAGGAGGAGUU | 2461 |
| D-1954 | 522-540 | — | UCCUCCUGCUCUCCCUGGGUU | 959 | CCCAGGGAGAGCAGGAGGAUU | 2462 |
| D-1955 | 5-23 | 5-23 | AACGGUGCACGGAAGAGUGUU | 960 | CACUCUUCCGUGCACCGUUUU | 2463 |
| D-1956 | 523-541 | — | CCUCCUGCUCUCCCUGGGCUU | 961 | GCCCAGGGAGAGCAGGAGGUU | 2464 |
| D-1957 | 524-542 | — | CUCCUGCUCUCCCUGGGCCUU | 962 | GGCCCAGGGAGAGCAGGAGUU | 2465 |
| D-1958 | 525-543 | — | UCCUGCUCUCCCUGGGCCUUU | 963 | AGGCCCAGGGAGAGCAGGAUU | 2466 |
| D-1959 | 526-544 | — | CCUGCUCUCCCUGGGCCUCUU | 964 | GAGGCCCAGGGAGAGCAGGUU | 2467 |
| D-1960 | 52-70 | 52-70 | GAUUCUCCUCCCUGGGGAGUU | 965 | CUCCCCAGGGAGGAGAAUCUU | 2468 |
| D-1961 | 527-545 | — | CUGCUCUCCCUGGGCCUCAUU | 966 | UGAGGCCCAGGGAGAGCAGUU | 2469 |
| D-1962 | 528-546 | — | UGCUCUCCCUGGGCCUCAGUU | 967 | CUGAGGCCCAGGGAGAGCAUU | 2470 |
| D-1963 | 529-547 | — | GCUCUCCCUGGGCCUCAGCUU | 968 | GCUGAGGCCCAGGGAGAGCUU | 2471 |
| D-1964 | 530-548 | — | CUCUCCCUGGGCCUCAGCCUU | 969 | GGCUGAGGCCCAGGGAGAGUU | 2472 |
| D-1965 | 531-549 | — | UCUCCCUGGGCCUCAGCCUUU | 970 | AGGCUGAGGCCCAGGGAGAUU | 2473 |
| D-1966 | 532-550 | — | CUCCCUGGGCCUCAGCCUCUU | 971 | GAGGCUGAGGCCCAGGGAGUU | 2474 |
| D-1967 | 533-551 | — | UCCCUGGGCCUCAGCCUCCUU | 972 | GGAGGCUGAGGCCCAGGGAUU | 2475 |
| D-1968 | 534-552 | — | CCCUGGGCCUCAGCCUCCUUU | 973 | AGGAGGCUGAGGCCCAGGGUU | 2476 |
| D-1969 | 535-553 | — | CCUGGGCCUCAGCCUCCUGUU | 974 | CAGGAGGCUGAGGCCCAGGUU | 2477 |
| D-1970 | 536-554 | — | CUGGGCCUCAGCCUCCUGCUU | 975 | GCAGGAGGCUGAGGCCCAGUU | 2478 |
| D-1971 | 53-71 | 53-71 | AUUCUCCUCCCUGGGGAGCUU | 976 | GCUCCCCAGGGAGGAGAAUUU | 2479 |
| D-1972 | 537-555 | — | UGGGCCUCAGCCUCCUGCUUU | 977 | AGCAGGAGGCUGAGGCCCAUU | 2480 |
| D-1973 | 538-556 | — | GGGCCUCAGCCUCCUGCUGUU | 978 | CAGCAGGAGGCUGAGGCCCUU | 2481 |
| D-1974 | 539-557 | — | GGCCUCAGCCUCCUGCUGCUU | 979 | GCAGCAGGAGGCUGAGGCCUU | 2482 |
| D-1975 | 540-558 | — | GCCUCAGCCUCCUGCUGCUUU | 980 | AGCAGCAGGAGGCUGAGGCUU | 2483 |
| D-1976 | 541-559 | — | CCUCAGCCUCCUGCUGCUUUU | 981 | AAGCAGCAGGAGGCUGAGGUU | 2484 |
| D-1977 | 542-560 | — | CUCAGCCUCCUGCUGCUUGUU | 982 | CAAGCAGCAGGAGGCUGAGUU | 2485 |
| D-1978 | 543-561 | — | UCAGCCUCCUGCUGCUUGUUU | 983 | ACAAGCAGCAGGAGGCUGAUU | 2486 |
| D-1979 | 544-562 | — | CAGCCUCCUGCUGCUUGUGUU | 984 | CACAAGCAGCAGGAGGCUGUU | 2487 |
| D-1980 | 545-563 | — | AGCCUCCUGCUGCUUGUGGUU | 985 | CCACAAGCAGCAGGAGGCUUU | 2488 |
| D-1981 | 546-564 | — | GCCUCCUGCUGCUUGUGGUUU | 986 | ACCACAAGCAGCAGGAGGCUU | 2489 |
| D-1982 | 54-72 | 54-72 | UUCUCCUCCCUGGGGAGCAUU | 987 | UGCUCCCCAGGGAGGAGAAUU | 2490 |
| D-1983 | 547-565 | — | CCUCCUGCUGCUUGUGGUUUU | 988 | AACCACAAGCAGCAGGAGGUU | 2491 |
| D-1984 | 548-566 | — | CUCCUGCUGCUUGUGGUUGUU | 989 | CAACCACAAGCAGCAGGAGUU | 2492 |
| D-1985 | 549-567 | - | UCCUGCUGCUUGUGGUUGUUU | 990 | ACAACCACAAGCAGCAGGAUU | 2493 |
| D-1986 | 550-568 | — | CCUGCUGCUUGUGGUUGUCUU | 991 | GACAACCACAAGCAGCAGGUU | 2494 |
| D-1987 | 551-569 | — | CUGCUGCUUGUGGUUGUCUUU | 992 | AGACAACCACAAGCAGCAGUU | 2495 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-1988 | 552-570 | — | UGCUGCUUGUGGUUGUCUGUU | 993 | CAGACAACCACAAGCAGCAUU | 2496 |
| D-1989 | 553-571 | — | GCUGCUUGUGGUUGUCUGUUU | 994 | ACAGACAACCACAAGCAGCUU | 2497 |
| D-1990 | 554-572 | — | CUGCUUGUGGUUGUCUGUGUU | 995 | CACAGACAACCACAAGCAGUU | 2498 |
| D-1991 | 555-573 | — | UGCUUGUGGUUGUCUGUGUUU | 996 | ACACAGACAACCACAAGCAUU | 2499 |
| D-1992 | 556-574 | — | GCUUGUGGUUGUCUGUGUGUU | 997 | CACACAGACAACCACAAGCUU | 2500 |
| D-1993 | 55-73 | 55-73 | UCUCCUCCCUGGGGAGCAGUU | 998 | CUGCUCCCCAGGGAGGAGAUU | 2501 |
| D-1994 | 557-575 | — | CUUGUGGUUGUCUGUGUGAUU | 999 | UCACACAGACAACCACAAGUU | 2502 |
| D-1995 | 558-576 | — | UUGUGGUUGUCUGUGUGAUUU | 1000 | AUCACACAGACAACCACAAUU | 2503 |
| D-1996 | 559-577 | — | UGUGGUUGUCUGUGUGAUCUU | 1001 | GAUCACACAGACAACCACAUU | 2504 |
| D-1997 | 560-578 | — | GUGGUUGUCUGUGUGAUCGUU | 1002 | CGAUCACACAGACAACCACUU | 2505 |
| D-1998 | 561-579 | — | UGGUUGUCUGUGUGAUCGGUU | 1003 | CCGAUCACACAGACAACCAUU | 2506 |
| D-1999 | 562-580 | — | GGUUGUCUGUGUGAUCGGAUU | 1004 | UCCGAUCACACAGACAACCUU | 2507 |
| D-2000 | 563-581 | — | GUUGUCUGUGUGAUCGGAUUU | 1005 | AUCCGAUCACACAGACAACUU | 2508 |
| D-2001 | 564-582 | — | UUGUCUGUGUGAUCGGAUCUU | 1006 | GAUCCGAUCACACAGACAAUU | 2509 |
| D-2002 | 565-583 | — | UGUCUGUGUGAUCGGAUCCUU | 1007 | GGAUCCGAUCACACAGACAUU | 2510 |
| D-2003 | 566-584 | — | GUCUGUGUGAUCGGAUCCCUU | 1008 | GGGAUCCGAUCACACAGACUU | 2511 |
| D-2004 | 56-74 | 56-74 | CUCCUCCCUGGGGAGCAGAUU | 1009 | UCUGCUCCCCAGGGAGGAGUU | 2512 |
| D-2005 | 567-585 | — | UCUGUGUGAUCGGAUCCCAUU | 1010 | UGGGAUCCGAUCACACAGAUU | 2513 |
| D-2006 | 568-586 | — | CUGUGUGAUCGGAUCCCAAUU | 1011 | UUGGGAUCCGAUCACACAGUU | 2514 |
| D-2007 | 569-587 | — | UGUGUGAUCGGAUCCCAAAUU | 1012 | UUUGGGAUCCGAUCACACAUU | 2515 |
| D-2008 | 570-588 | — | GUGUGAUCGGAUCCCAAAAUU | 1013 | UUUUGGGAUCCGAUCACACUU | 2516 |
| D-2009 | 571-589 | — | UGUGAUCGGAUCCCAAAACUU | 1014 | GUUUUGGGAUCCGAUCACAUU | 2517 |
| D-2010 | 572-590 | — | GUGAUCGGAUCCCAAAACUUU | 1015 | AGUUUUGGGAUCCGAUCACUU | 2518 |
| D-2011 | 573-591 | — | UGAUCGGAUCCCAAAACUCUU | 1016 | GAGUUUUGGGAUCCGAUCAUU | 2519 |
| D-2012 | 574-592 | — | GAUCGGAUCCCAAAACUCCUU | 1017 | GGAGUUUUGGGAUCCGAUCUU | 2520 |
| D-2013 | 575-593 | — | AUCGGAUCCCAAAACUCCCUU | 1018 | GGGAGUUUUGGGAUCCGAUUU | 2521 |
| D-2014 | 576-594 | — | UCGGAUCCCAAAACUCCCAUU | 1019 | UGGGAGUUUUGGGAUCCGAUU | 2522 |
| D-2015 | 57-75 | 57-75 | UCCUCCCUGGGGAGCAGAGUU | 1020 | CUCUGCUCCCCAGGGAGGAUU | 2523 |
| D-2016 | 577-595 | — | CGGAUCCCAAAACUCCCAGUU | 1021 | CUGGGAGUUUUGGGAUCCGUU | 2524 |
| D-2017 | 578-596 | — | GGAUCCCAAAACUCCCAGCUU | 1022 | GCUGGGAGUUUUGGGAUCCUU | 2525 |
| D-2018 | 579-597 | — | GAUCCCAAAACUCCCAGCUUU | 1023 | AGCUGGGAGUUUUGGGAUCUU | 2526 |
| D-2019 | 580-598 | — | AUCCCAAAACUCCCAGCUGUU | 1024 | CAGCUGGGAGUUUUGGGAUUU | 2527 |
| D-2020 | 581-599 | — | UCCCAAAACUCCCAGCUGCUU | 1025 | GCAGCUGGGAGUUUUGGGAUU | 2528 |
| D-2021 | 582-600 | — | CCCAAAACUCCCAGCUGCAUU | 1026 | UGCAGCUGGGAGUUUUGGGUU | 2529 |
| D-2022 | 583-601 | — | CCAAAACUCCCAGCUGCAGUU | 1027 | CUGCAGCUGGGAGUUUUGGUU | 2530 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2023 | 584-602 | — | CAAAACUCCCAGCUGCAGGUU | 1028 | CCUGCAGCUGGGAGUUUUGUU | 2531 |
| D-2024 | 585-603 | — | AAAACUCCCAGCUGCAGGAUU | 1029 | UCCUGCAGCUGGGAGUUUUUU | 2532 |
| D-2025 | 586-604 | — | AAACUCCCAGCUGCAGGAGUU | 1030 | CUCCUGCAGCUGGGAGUUUUU | 2533 |
| D-2026 | 58-76 | 58-76 | CCUCCCUGGGGAGCAGAGCUU | 1031 | GCUCUGCUCCCCAGGGAGGUU | 2534 |
| D-2027 | 587-605 | — | AACUCCCAGCUGCAGGAGGUU | 1032 | CCUCCUGCAGCUGGGAGUUUU | 2535 |
| D-2028 | 588-606 | 471-489 | ACUCCCAGCUGCAGGAGGAUU | 1033 | UCCUCCUGCAGCUGGGAGUUU | 2536 |
| D-2029 | 589-607 | 472-490 | CUCCCAGCUGCAGGAGGAGUU | 1034 | CUCCUCCUGCAGCUGGGAGUU | 2537 |
| D-2030 | 590-608 | 473-491 | UCCCAGCUGCAGGAGGAGCUU | 1035 | GCUCCUCCUGCAGCUGGGAUU | 2538 |
| D-2031 | 591-609 | 474-492 | CCCAGCUGCAGGAGGAGCUUU | 1036 | AGCUCCUCCUGCAGCUGGGUU | 2539 |
| D-2032 | 592-610 | 475-493 | CCAGCUGCAGGAGGAGCUGUU | 1037 | CAGCUCCUCCUGCAGCUGGUU | 2540 |
| D-2033 | 593-611 | 476-494 | CAGCUGCAGGAGGAGCUGCUU | 1038 | GCAGCUCCUCCUGCAGCUGUU | 2541 |
| D-2034 | 594-612 | 477-495 | AGCUGCAGGAGGAGCUGCGUU | 1039 | CGCAGCUCCUCCUGCAGCUUU | 2542 |
| D-2035 | 595-613 | 478-496 | GCUGCAGGAGGAGCUGCGGUU | 1040 | CCGCAGCUCCUCCUGCAGCUU | 2543 |
| D-2036 | 596-614 | 479-497 | CUGCAGGAGGAGCUGCGGGUU | 1041 | CCCGCAGCUCCUCCUGCAGUU | 2544 |
| D-2037 | 597-615 | 480-498 | UGCAGGAGGAGCUGCGGGGUU | 1042 | CCCCGCAGCUCCUCCUGCAUU | 2545 |
| D-2038 | 59-77 | 59-77 | CUCCCUGGGGAGCAGAGCAUU | 1043 | UGCUCUGCUCCCCAGGGAGUU | 2546 |
| D-2039 | 598-616 | 481-499 | GCAGGAGGAGCUGCGGGGCUU | 1044 | GCCCCGCAGCUCCUCCUGCUU | 2547 |
| D-2040 | 599-617 | 482-500 | CAGGAGGAGCUGCGGGGCCUU | 1045 | GGCCCCGCAGCUCCUCCUGUU | 2548 |
| D-2041 | 600-618 | 483-501 | AGGAGGAGCUGCGGGGCCUUU | 1046 | AGGCCCCGCAGCUCCUCCUUU | 2549 |
| D-2042 | 601-619 | 484-502 | GGAGGAGCUGCGGGGCCUGUU | 1047 | CAGGCCCCGCAGCUCCUCCUU | 2550 |
| D-2043 | 602-620 | 485-503 | GAGGAGCUGCGGGGCCUGAUU | 1048 | UCAGGCCCCGCAGCUCCUCUU | 2551 |
| D-2044 | 603-621 | 486-504 | AGGAGCUGCGGGGCCUGAGUU | 1049 | CUCAGGCCCCGCAGCUCCUUU | 2552 |
| D-2045 | 604-622 | 487-505 | GGAGCUGCGGGGCCUGAGAUU | 1050 | UCUCAGGCCCCGCAGCUCCUU | 2553 |
| D-2046 | 605-623 | 488-506 | GAGCUGCGGGGCCUGAGAGUU | 1051 | CUCUCAGGCCCCGCAGCUCUU | 2554 |
| D-2047 | 606-624 | 489-507 | AGCUGCGGGGCCUGAGAGAUU | 1052 | UCUCUCAGGCCCCGCAGCUUU | 2555 |
| D-2048 | 607-625 | 490-508 | GCUGCGGGGCCUGAGAGAGUU | 1053 | CUCUCUCAGGCCCCGCAGCUU | 2556 |
| D-2049 | 60-78 | 60-78 | UCCCUGGGGAGCAGAGCAGUU | 1054 | CUGCUCUGCUCCCCAGGGAUU | 2557 |
| D-2050 | 608-626 | 491-509 | CUGCGGGGCCUGAGAGAGAUU | 1055 | UCUCUCUCAGGCCCCGCAGUU | 2558 |
| D-2051 | 609-627 | 492-510 | UGCGGGGCCUGAGAGAGACUU | 1056 | GUCUCUCUCAGGCCCCGCAUU | 2559 |
| D-2052 | 610-628 | 493-511 | GCGGGGCCUGAGAGAGACGUU | 1057 | CGUCUCUCUCAGGCCCCGCUU | 2560 |
| D-2053 | 611-629 | 494-512 | CGGGGCCUGAGAGAGACGUUU | 1058 | ACGUCUCUCUCAGGCCCCGUU | 2561 |
| D-2054 | 612-630 | 495-513 | GGGGCCUGAGAGAGACGUUUU | 1059 | AACGUCUCUCUCAGGCCCCUU | 2562 |
| D-2055 | 613-631 | 496-514 | GGGCCUGAGAGAGACGUUCUU | 1060 | GAACGUCUCUCUCAGGCCCUU | 2563 |
| D-2056 | 614-632 | 497-515 | GGCCUGAGAGAGACGUUCAUU | 1061 | UGAACGUCUCUCUCAGGCCUU | 2564 |
| D-2057 | 615-633 | 498-516 | GCCUGAGAGAGACGUUCAGUU | 1062 | CUGAACGUCUCUCUCAGGCUU | 2565 |
| D-2058 | 616-634 | 499-517 | CCUGAGAGAGACGUUCAGCUU | 1063 | GCUGAACGUCUCUCUCAGGUU | 2566 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2059 | 617-635 | 500-518 | CUGAGAGAGACGUUCAGCAUU | 1064 | UGCUGAACGUCUCUCUCAGUU | 2567 |
| D-2060 | 61-79 | 61-79 | CCCUGGGGAGCAGAGCAGAUU | 1065 | UCUGCUCUGCUCCCCAGGGUU | 2568 |
| D-2061 | 618-636 | 501-519 | UGAGAGAGACGUUCAGCAAUU | 1066 | UUGCUGAACGUCUCUCUCAUU | 2569 |
| D-2062 | 619-637 | 502-520 | GAGAGAGACGUUCAGCAACUU | 1067 | GUUGCUGAACGUCUCUCUCUU | 2570 |
| D-2063 | 620-638 | 503-521 | AGAGAGACGUUCAGCAACUUU | 1068 | AGUUGCUGAACGUCUCUCUUU | 2571 |
| D-2064 | 621-639 | 504-522 | GAGAGACGUUCAGCAACUUUU | 1069 | AAGUUGCUGAACGUCUCUCUU | 2572 |
| D-2065 | 622-640 | 505-523 | AGAGACGUUCAGCAACUUCUU | 1070 | GAAGUUGCUGAACGUCUCUUU | 2573 |
| D-2066 | 623-641 | 506-524 | GAGACGUUCAGCAACUUCAUU | 1071 | UGAAGUUGCUGAACGUCUCUU | 2574 |
| D-2067 | 6-24 | 6-24 | ACGGUGCACGGAAGAGUGAUU | 1072 | UCACUCUUCCGUGCACCGUUU | 2575 |
| D-2068 | 624-642 | 507-525 | AGACGUUCAGCAACUUCACUU | 1073 | GUGAAGUUGCUGAACGUCUUU | 2576 |
| D-2069 | 625-643 | 508-526 | GACGUUCAGCAACUUCACAUU | 1074 | UGUGAAGUUGCUGAACGUCUU | 2577 |
| D-2070 | 626-644 | 509-527 | ACGUUCAGCAACUUCACAGUU | 1075 | CUGUGAAGUUGCUGAACGUUU | 2578 |
| D-2071 | 627-645 | 510-528 | CGUUCAGCAACUUCACAGCUU | 1076 | GCUGUGAAGUUGCUGAACGUU | 2579 |
| D-2072 | 62-80 | 62-80 | CCUGGGGAGCAGAGCAGAGUU | 1077 | CUCUGCUCUGCUCCCCAGGUU | 2580 |
| D-2073 | 628-646 | 511-529 | GUUCAGCAACUUCACAGCGUU | 1078 | CGCUGUGAAGUUGCUGAACUU | 2581 |
| D-2074 | 629-647 | 512-530 | UUCAGCAACUUCACAGCGAUU | 1079 | UCGCUGUGAAGUUGCUGAAUU | 2582 |
| D-2075 | 630-648 | 513-531 | UCAGCAACUUCACAGCGAGUU | 1080 | CUCGCUGUGAAGUUGCUGAUU | 2583 |
| D-2076 | 631-649 | 514-532 | CAGCAACUUCACAGCGAGCUU | 1081 | GCUCGCUGUGAAGUUGCUGUU | 2584 |
| D-2077 | 632-650 | 515-533 | AGCAACUUCACAGCGAGCAUU | 1082 | UGCUCGCUGUGAAGUUGCUUU | 2585 |
| D-2078 | 633-651 | 516-534 | GCAACUUCACAGCGAGCACUU | 1083 | GUGCUCGCUGUGAAGUUGCUU | 2586 |
| D-2079 | 634-652 | 517-535 | CAACUUCACAGCGAGCACGUU | 1084 | CGUGCUCGCUGUGAAGUUGUU | 2587 |
| D-2080 | 635-653 | 518-536 | AACUUCACAGCGAGCACGGUU | 1085 | CCGUGCUCGCUGUGAAGUUUU | 2588 |
| D-2081 | 636-654 | 519-537 | ACUUCACAGCGAGCACGGAUU | 1086 | UCCGUGCUCGCUGUGAAGUUU | 2589 |
| D-2082 | 637-655 | 520-538 | CUUCACAGCGAGCACGGAGUU | 1087 | CUCCGUGCUCGCUGUGAAGUU | 2590 |
| D-2083 | 63-81 | 63-81 | CUGGGGAGCAGAGCAGAGGUU | 1088 | CCUCUGCUCUGCUCCCCAGUU | 2591 |
| D-2084 | 638-656 | 521-539 | UUCACAGCGAGCACGGAGGUU | 1089 | CCUCCGUGCUCGCUGUGAAUU | 2592 |
| D-2085 | 639-657 | 522-540 | UCACAGCGAGCACGGAGGCUU | 1090 | GCCUCCGUGCUCGCUGUGAUU | 2593 |
| D-2086 | 640-658 | 523-541 | CACAGCGAGCACGGAGGCCUU | 1091 | GGCCUCCGUGCUCGCUGUGUU | 2594 |
| D-2087 | 641-659 | 524-542 | ACAGCGAGCACGGAGGCCCUU | 1092 | GGGCCUCCGUGCUCGCUGUUU | 2595 |
| D-2088 | 642-660 | 525-543 | CAGCGAGCACGGAGGCCCAUU | 1093 | UGGGCCUCCGUGCUCGCUGUU | 2596 |
| D-2089 | 643-661 | 526-544 | AGCGAGCACGGAGGCCCAGUU | 1094 | CUGGGCCUCCGUGCUCGCUUU | 2597 |
| D-2090 | 644-662 | 527-545 | GCGAGCACGGAGGCCCAGGUU | 1095 | CCUGGGCCUCCGUGCUCGCUU | 2598 |
| D-2091 | 645-663 | 528-546 | CGAGCACGGAGGCCCAGGUUU | 1096 | ACCUGGGCCUCCGUGCUCGUU | 2599 |
| D-2092 | 646-664 | 529-547 | GAGCACGGAGGCCCAGGUCUU | 1097 | GACCUGGGCCUCCGUGCUCUU | 2600 |
| D-2093 | 647-665 | 530-548 | AGCACGGAGGCCCAGGUCAUU | 1098 | UGACCUGGGCCUCCGUGCUUU | 2601 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2094 | 64-82 | 64-82 | UGGGGAGCAGAGCAGAGGCUU | 1099 | GCCUCUGCUCUGCUCCCCAUU | 2602 |
| D-2095 | 648-666 | 531-549 | GCACGGAGGCCCAGGUCAAUU | 1100 | UUGACCUGGGCCUCCGUGCUU | 2603 |
| D-2096 | 649-667 | 532-550 | CACGGAGGCCCAGGUCAAGUU | 1101 | CUUGACCUGGGCCUCCGUGUU | 2604 |
| D-2097 | 650-668 | 533-551 | ACGGAGGCCCAGGUCAAGGUU | 1102 | CCUUGACCUGGGCCUCCGUUU | 2605 |
| D-2098 | 651-669 | 534-552 | CGGAGGCCCAGGUCAAGGGUU | 1103 | CCCUUGACCUGGGCCUCCGUU | 2606 |
| D-2099 | 652-670 | 535-553 | GGAGGCCCAGGUCAAGGGCUU | 1104 | GCCCUUGACCUGGGCCUCCUU | 2607 |
| D-2100 | 653-671 | 536-554 | GAGGCCCAGGUCAAGGGCUUU | 1105 | AGCCCUUGACCUGGGCCUCUU | 2608 |
| D-2101 | 654-672 | 537-555 | AGGCCCAGGUCAAGGGCUUUU | 1106 | AAGCCCUUGACCUGGGCCUUU | 2609 |
| D-2102 | 655-673 | 538-556 | GGCCCAGGUCAAGGGCUUGUU | 1107 | CAAGCCCUUGACCUGGGCCUU | 2610 |
| D-2103 | 656-674 | 539-557 | GCCCAGGUCAAGGGCUUGAUU | 1108 | UCAAGCCCUUGACCUGGGCUU | 2611 |
| D-2104 | 657-675 | 540-558 | CCCAGGUCAAGGGCUUGAGUU | 1109 | CUCAAGCCCUUGACCUGGGUU | 2612 |
| D-2105 | 65-83 | 65-83 | GGGGAGCAGAGCAGAGGCAUU | 1110 | UGCCUCUGCUCUGCUCCCCUU | 2613 |
| D-2106 | 658-676 | 541-559 | CCAGGUCAAGGGCUUGAGCUU | 1111 | GCUCAAGCCCUUGACCUGGUU | 2614 |
| D-2107 | 659-677 | 542-560 | CAGGUCAAGGGCUUGAGCAUU | 1112 | UGCUCAAGCCCUUGACCUGUU | 2615 |
| D-2108 | 660-678 | 543-561 | AGGUCAAGGGCUUGAGCACUU | 1113 | GUGCUCAAGCCCUUGACCUUU | 2616 |
| D-2109 | 661-679 | 544-562 | GGUCAAGGGCUUGAGCACCUU | 1114 | GGUGCUCAAGCCCUUGACCUU | 2617 |
| D-2110 | 662-680 | 545-563 | GUCAAGGGCUUGAGCACCCUU | 1115 | GGGUGCUCAAGCCCUUGACUU | 2618 |
| D-2111 | 663-681 | 546-564 | UCAAGGGCUUGAGCACCCAUU | 1116 | UGGGUGCUCAAGCCCUUGAUU | 2619 |
| D-2112 | 664-682 | 547-565 | CAAGGGCUUGAGCACCCAGUU | 1117 | CUGGGUGCUCAAGCCCUUGUU | 2620 |
| D-2113 | 665-683 | 548-566 | AAGGGCUUGAGCACCCAGGUU | 1118 | CCUGGGUGCUCAAGCCCUUUU | 2621 |
| D-2114 | 666-684 | 549-567 | AGGGCUUGAGCACCCAGGGUU | 1119 | CCCUGGGUGCUCAAGCCCUUU | 2622 |
| D-2115 | 667-685 | 550-568 | GGGCUUGAGCACCCAGGGAUU | 1120 | UCCCUGGGUGCUCAAGCCCUU | 2623 |
| D-2116 | 66-84 | 66-84 | GGGAGCAGAGCAGAGGCAAUU | 1121 | UUGCCUCUGCUCUGCUCCCUU | 2624 |
| D-2117 | 668-686 | 551-569 | GGCUUGAGCACCCAGGGAGUU | 1122 | CUCCCUGGGUGCUCAAGCCUU | 2625 |
| D-2118 | 669-687 | 552-570 | GCUUGAGCACCCAGGGAGGUU | 1123 | CCUCCCUGGGUGCUCAAGCUU | 2626 |
| D-2119 | 670-688 | 553-571 | CUUGAGCACCCAGGGAGGCUU | 1124 | GCCUCCCUGGGUGCUCAAGUU | 2627 |
| D-2120 | 671-689 | 554-572 | UUGAGCACCCAGGGAGGCAUU | 1125 | UGCCUCCCUGGGUGCUCAAUU | 2628 |
| D-2121 | 672-690 | 555-573 | UGAGCACCCAGGGAGGCAAUU | 1126 | UUGCCUCCCUGGGUGCUCAUU | 2629 |
| D-2122 | 673-691 | 556-574 | GAGCACCCAGGGAGGCAAUUU | 1127 | AUUGCCUCCCUGGGUGCUCUU | 2630 |
| D-2123 | 674-692 | 557-575 | AGCACCCAGGGAGGCAAUGUU | 1128 | CAUUGCCUCCCUGGGUGCUUU | 2631 |
| D-2124 | 675-693 | 558-576 | GCACCCAGGGAGGCAAUGUUU | 1129 | ACAUUGCCUCCCUGGGUGCUU | 2632 |
| D-2125 | 676-694 | 559-577 | CACCCAGGGAGGCAAUGUGUU | 1130 | CACAUUGCCUCCCUGGGUGUU | 2633 |
| D-2126 | 677-695 | 560-578 | ACCCAGGGAGGCAAUGUGGUU | 1131 | CCACAUUGCCUCCCUGGGUUU | 2634 |
| D-2127 | 67-85 | 67-85 | GGAGCAGAGCAGAGGCAACUU | 1132 | GUUGCCUCUGCUCUGCUCCUU | 2635 |
| D-2128 | 678-696 | 561-579 | CCCAGGGAGGCAAUGUGGGUU | 1133 | CCCACAUUGCCUCCCUGGGUU | 2636 |
| D-2129 | 679-697 | 562-580 | CCAGGGAGGCAAUGUGGGAUU | 1134 | UCCCACAUUGCCUCCCUGGUU | 2637 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2130 | 680-698 | 563-581 | CAGGGAGGCAAUGUGGGAAUU | 1135 | UUCCCACAUUGCCUCCCUGUU | 2638 |
| D-2131 | 681-699 | 564-582 | AGGGAGGCAAUGUGGGAAGUU | 1136 | CUUCCCACAUUGCCUCCCUUU | 2639 |
| D-2132 | 682-700 | 565-583 | GGGAGGCAAUGUGGGAAGAUU | 1137 | UCUUCCCACAUUGCCUCCCUU | 2640 |
| D-2133 | 683-701 | 566-584 | GGAGGCAAUGUGGGAAGAAUU | 1138 | UUCUUCCCACAUUGCCUCCUU | 2641 |
| D-2134 | 684-702 | 567-585 | GAGGCAAUGUGGGAAGAAAUU | 1139 | UUUCUUCCCACAUUGCCUCUU | 2642 |
| D-2135 | 685-703 | 568-586 | AGGCAAUGUGGGAAGAAAGUU | 1140 | CUUUCUUCCCACAUUGCCUUU | 2643 |
| D-2136 | 686-704 | 569-587 | GGCAAUGUGGGAAGAAAGAUU | 1141 | UCUUUCUUCCCACAUUGCCUU | 2644 |
| D-2137 | 687-705 | 570-588 | GCAAUGUGGGAAGAAAGAUUU | 1142 | AUCUUUCUUCCCACAUUGCUU | 2645 |
| D-2138 | 68-86 | 68-86 | GAGCAGAGCAGAGGCAACCUU | 1143 | GGUUGCCUCUGCUCUGCUCUU | 2646 |
| D-2139 | 688-706 | 571-589 | CAAUGUGGGAAGAAAGAUGUU | 1144 | CAUCUUUCUUCCCACAUUGUU | 2647 |
| D-2140 | 689-707 | 572-590 | AAUGUGGGAAGAAAGAUGAUU | 1145 | UCAUCUUUCUUCCCACAUUUU | 2648 |
| D-2141 | 690-708 | 573-591 | AUGUGGGAAGAAAGAUGAAUU | 1146 | UUCAUCUUUCUUCCCACAUUU | 2649 |
| D-2142 | 691-709 | 574-592 | UGUGGGAAGAAAGAUGAAGUU | 1147 | CUUCAUCUUUCUUCCCACAUU | 2650 |
| D-2143 | 692-710 | 575-593 | GUGGGAAGAAAGAUGAAGUUU | 1148 | ACUUCAUCUUUCUUCCCACUU | 2651 |
| D-2144 | 693-711 | 576-594 | UGGGAAGAAAGAUGAAGUCUU | 1149 | GACUUCAUCUUUCUUCCCAUU | 2652 |
| D-2145 | 694-712 | 577-595 | GGGAAGAAAGAUGAAGUCGUU | 1150 | CGACUUCAUCUUUCUUCCCUU | 2653 |
| D-2146 | 695-713 | 578-596 | GGAAGAAAGAUGAAGUCGCUU | 1151 | GCGACUUCAUCUUUCUUCCUU | 2654 |
| D-2147 | 696-714 | 579-597 | GAAGAAAGAUGAAGUCGCUUU | 1152 | AGCGACUUCAUCUUUCUUCUU | 2655 |
| D-2148 | 697-715 | 580-598 | AAGAAAGAUGAAGUCGCUAUU | 1153 | UAGCGACUUCAUCUUUCUUUU | 2656 |
| D-2149 | 69-87 | 69-87 | AGCAGAGCAGAGGCAACCCUU | 1154 | GGGUUGCCUCUGCUCUGCUUU | 2657 |
| D-2150 | 698-716 | 581-599 | AGAAAGAUGAAGUCGCUAGUU | 1155 | CUAGCGACUUCAUCUUUCUUU | 2658 |
| D-2151 | 699-717 | 581-600 | GAAAGAUGAAGUCGCUAGAUU | 1156 | UCUAGCGACUUCAUCUUUCUU | 2659 |
| D-2152 | 700-718 | 581-601 | AAAGAUGAAGUCGCUAGAGUU | 1157 | CUCUAGCGACUUCAUCUUUUU | 2660 |
| D-2153 | 701-719 | 581-602 | AAGAUGAAGUCGCUAGAGUUU | 1158 | ACUCUAGCGACUUCAUCUUUU | 2661 |
| D-2154 | 702-720 | 581-603 | AGAUGAAGUCGCUAGAGUCUU | 1159 | GACUCUAGCGACUUCAUCUUU | 2662 |
| D-2155 | 703-721 | 581-604 | GAUGAAGUCGCUAGAGUCCUU | 1160 | GGACUCUAGCGACUUCAUCUU | 2663 |
| D-2156 | 704-722 | 581-605 | AUGAAGUCGCUAGAGUCCCUU | 1161 | GGGACUCUAGCGACUUCAUUU | 2664 |
| D-2157 | 705-723 | 581-606 | UGAAGUCGCUAGAGUCCCAUU | 1162 | UGGGACUCUAGCGACUUCAUU | 2665 |
| D-2158 | 706-724 | 581-607 | GAAGUCGCUAGAGUCCCAGUU | 1163 | CUGGGACUCUAGCGACUUCUU | 2666 |
| D-2159 | 707-725 | 581-608 | AAGUCGCUAGAGUCCCAGCUU | 1164 | GCUGGGACUCUAGCGACUUUU | 2667 |
| D-2160 | 708-726 | 581-609 | AGUCGCUAGAGUCCCAGCUUU | 1165 | AGCUGGGACUCUAGCGACUUU | 2668 |
| D-2161 | 70-88 | 70-88 | GCAGAGCAGAGGCAACCCAUU | 1166 | UGGGUUGCCUCUGCUCUGCUU | 2669 |
| D-2162 | 709-727 | 592-610 | GUCGCUAGAGUCCCAGCUGUU | 1167 | CAGCUGGGACUCUAGCGACUU | 2670 |
| D-2163 | 710-728 | 593-611 | UCGCUAGAGUCCCAGCUGGUU | 1168 | CCAGCUGGGACUCUAGCGAUU | 2671 |
| D-2164 | 711-729 | 594-612 | CGCUAGAGUCCCAGCUGGAUU | 1169 | UCCAGCUGGGACUCUAGCGUU | 2672 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2165 | 712-730 | 595-613 | GCUAGAGUCCCAGCUGGAGUU | 1170 | CUCCAGCUGGGACUCUAGCUU | 2673 |
| D-2166 | 713-731 | 596-614 | CUAGAGUCCCAGCUGGAGAUU | 1171 | UCUCCAGCUGGGACUCUAGUU | 2674 |
| D-2167 | 714-732 | 597-615 | UAGAGUCCCAGCUGGAGAAUU | 1172 | UUCUCCAGCUGGGACUCUAUU | 2675 |
| D-2168 | 715-733 | 598-616 | AGAGUCCCAGCUGGAGAAAUU | 1173 | UUUCUCCAGCUGGGACUCUUU | 2676 |
| D-2169 | 716-734 | 599-617 | GAGUCCCAGCUGGAGAAACUU | 1174 | GUUUCUCCAGCUGGGACUCUU | 2677 |
| D-2170 | 717-735 | 600-618 | AGUCCCAGCUGGAGAAACAUU | 1175 | UGUUUCUCCAGCUGGGACUUU | 2678 |
| D-2171 | 718-736 | 601-619 | GUCCCAGCUGGAGAAACAGUU | 1176 | CUGUUUCUCCAGCUGGGACUU | 2679 |
| D-2172 | 71-89 | 71-89 | CAGAGCAGAGGCAACCCAUUU | 1177 | AUGGGUUGCCUCUGCUCUGUU | 2680 |
| D-2173 | 719-737 | 602-620 | UCCCAGCUGGAGAAACAGCUU | 1178 | GCUGUUUCUCCAGCUGGGAUU | 2681 |
| D-2174 | 720-738 | 603-621 | CCCAGCUGGAGAAACAGCAUU | 1179 | UGCUGUUUCUCCAGCUGGGUU | 2682 |
| D-2175 | 721-739 | 604-622 | CCAGCUGGAGAAACAGCAGUU | 1180 | CUGCUGUUUCUCCAGCUGGUU | 2683 |
| D-2176 | 722-740 | 605-623 | CAGCUGGAGAAACAGCAGAUU | 1181 | UCUGCUGUUUCUCCAGCUGUU | 2684 |
| D-2177 | 723-741 | 606-624 | AGCUGGAGAAACAGCAGAAUU | 1182 | UUCUGCUGUUUCUCCAGCUUU | 2685 |
| D-2178 | 724-742 | 607-625 | GCUGGAGAAACAGCAGAAGUU | 1183 | CUUCUGCUGUUUCUCCAGCUU | 2686 |
| D-2179 | 7-25 | 7-25 | CGGUGCACGGAAGAGUGAGUU | 1184 | CUCACUCUUCCGUGCACCGUU | 2687 |
| D-2180 | 725-743 | 608-626 | CUGGAGAAACAGCAGAAGGUU | 1185 | CCUUCUGCUGUUUCUCCAGUU | 2688 |
| D-2181 | 726-744 | 609-627 | UGGAGAAACAGCAGAAGGAUU | 1186 | UCCUUCUGCUGUUUCUCCAUU | 2689 |
| D-2182 | 727-745 | 610-628 | GGAGAAACAGCAGAAGGACUU | 1187 | GUCCUUCUGCUGUUUCUCCUU | 2690 |
| D-2183 | 728-746 | 611-629 | GAGAAACAGCAGAAGGACCUU | 1188 | GGUCCUUCUGCUGUUUCUCUU | 2691 |
| D-2184 | 72-90 | 72-90 | AGAGCAGAGGCAACCCAUCUU | 1189 | GAUGGGUUGCCUCUGCUCUUU | 2692 |
| D-2185 | 729-747 | 612-630 | AGAAACAGCAGAAGGACCUUU | 1190 | AGGUCCUUCUGCUGUUUCUUU | 2693 |
| D-2186 | 730-748 | 613-631 | GAAACAGCAGAAGGACCUGUU | 1191 | CAGGUCCUUCUGCUGUUUCUU | 2694 |
| D-2187 | 731-749 | 614-632 | AAACAGCAGAAGGACCUGAUU | 1192 | UCAGGUCCUUCUGCUGUUUUU | 2695 |
| D-2188 | 732-750 | 615-633 | AACAGCAGAAGGACCUGAGUU | 1193 | CUCAGGUCCUUCUGCUGUUUU | 2696 |
| D-2189 | 733-751 | 616-634 | ACAGCAGAAGGACCUGAGUUU | 1194 | ACUCAGGUCCUUCUGCUGUUU | 2697 |
| D-2190 | 734-752 | 617-635 | CAGCAGAAGGACCUGAGUGUU | 1195 | CACUCAGGUCCUUCUGCUGUU | 2698 |
| D-2191 | 735-753 | 618-636 | AGCAGAAGGACCUGAGUGAUU | 1196 | UCACUCAGGUCCUUCUGCUUU | 2699 |
| D-2192 | 736-754 | 619-637 | GCAGAAGGACCUGAGUGAAUU | 1197 | UUCACUCAGGUCCUUCUGCUU | 2700 |
| D-2193 | 737-755 | 620-638 | CAGAAGGACCUGAGUGAAGUU | 1198 | CUUCACUCAGGUCCUUCUGUU | 2701 |
| D-2194 | 738-756 | 621-639 | AGAAGGACCUGAGUGAAGAUU | 1199 | UCUUCACUCAGGUCCUUCUUU | 2702 |
| D-2195 | 73-91 | 73-91 | GAGCAGAGGCAACCCAUCCUU | 1200 | GGAUGGGUUGCCUCUGCUCUU | 2703 |
| D-2196 | 739-757 | 622-640 | GAAGGACCUGAGUGAAGAUUU | 1201 | AUCUUCACUCAGGUCCUUCUU | 2704 |
| D-2197 | 740-758 | 623-641 | AAGGACCUGAGUGAAGAUCUU | 1202 | GAUCUUCACUCAGGUCCUUUU | 2705 |
| D-2198 | 741-759 | 624-642 | AGGACCUGAGUGAAGAUCAUU | 1203 | UGAUCUUCACUCAGGUCCUUU | 2706 |
| D-2199 | 742-760 | 625-643 | GGACCUGAGUGAAGAUCACUU | 1204 | GUGAUCUUCACUCAGGUCCUU | 2707 |
| D-2200 | 743-761 | 626-644 | GACCUGAGUGAAGAUCACUUU | 1205 | AGUGAUCUUCACUCAGGUCUU | 2708 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2201 | 744-762 | 627-645 | ACCUGAGUGAAGAUCACUCUU | 1206 | GAGUGAUCUUCACUCAGGUUU | 2709 |
| D-2202 | 745-763 | 628-646 | CCUGAGUGAAGAUCACUCCUU | 1207 | GGAGUGAUCUUCACUCAGGUU | 2710 |
| D-2203 | 746-764 | 629-647 | CUGAGUGAAGAUCACUCCAUU | 1208 | UGGAGUGAUCUUCACUCAGUU | 2711 |
| D-2204 | 747-765 | 630-648 | UGAGUGAAGAUCACUCCAGUU | 1209 | CUGGAGUGAUCUUCACUCAUU | 2712 |
| D-2205 | 748-766 | 631-649 | GAGUGAAGAUCACUCCAGCUU | 1210 | GCUGGAGUGAUCUUCACUCUU | 2713 |
| D-2206 | 74-92 | 74-92 | AGCAGAGGCAACCCAUCCCUU | 1211 | GGGAUGGGUUGCCUCUGCUUU | 2714 |
| D-2207 | 749-767 | 632-650 | AGUGAAGAUCACUCCAGCCUU | 1212 | GGCUGGAGUGAUCUUCACUUU | 2715 |
| D-2208 | 750-768 | 633-651 | GUGAAGAUCACUCCAGCCUUU | 1213 | AGGCUGGAGUGAUCUUCACUU | 2716 |
| D-2209 | 751-769 | 634-652 | UGAAGAUCACUCCAGCCUGUU | 1214 | CAGGCUGGAGUGAUCUUCAUU | 2717 |
| D-2210 | 752-770 | 635-653 | GAAGAUCACUCCAGCCUGCUU | 1215 | GCAGGCUGGAGUGAUCUUCUU | 2718 |
| D-2211 | 753-771 | 636-654 | AAGAUCACUCCAGCCUGCUUU | 1216 | AGCAGGCUGGAGUGAUCUUUU | 2719 |
| D-2212 | 754-772 | 637-655 | AGAUCACUCCAGCCUGCUGUU | 1217 | CAGCAGGCUGGAGUGAUCUUU | 2720 |
| D-2213 | 755-773 | 638-656 | GAUCACUCCAGCCUGCUGCUU | 1218 | GCAGCAGGCUGGAGUGAUCUU | 2721 |
| D-2214 | 756-774 | 639-657 | AUCACUCCAGCCUGCUGCUUU | 1219 | AGCAGCAGGCUGGAGUGAUUU | 2722 |
| D-2215 | 757-775 | 640-658 | UCACUCCAGCCUGCUGCUCUU | 1220 | GAGCAGCAGGCUGGAGUGAUU | 2723 |
| D-2216 | 758-776 | 641-659 | CACUCCAGCCUGCUGCUCCUU | 1221 | GGAGCAGCAGGCUGGAGUGUU | 2724 |
| D-2217 | 75-93 | 75-93 | GCAGAGGCAACCCAUCCCCUU | 1222 | GGGGAUGGGUUGCCUCUGCUU | 2725 |
| D-2218 | 759-777 | 642-660 | ACUCCAGCCUGCUGCUCCAUU | 1223 | UGGAGCAGCAGGCUGGAGUUU | 2726 |
| D-2219 | 760-778 | 643-661 | CUCCAGCCUGCUGCUCCACUU | 1224 | GUGGAGCAGCAGGCUGGAGUU | 2727 |
| D-2220 | 761-779 | 644-662 | UCCAGCCUGCUGCUCCACGUU | 1225 | CGUGGAGCAGCAGGCUGGAUU | 2728 |
| D-2221 | 762-780 | 645-663 | CCAGCCUGCUGCUCCACGUUU | 1226 | ACGUGGAGCAGCAGGCUGGUU | 2729 |
| D-2222 | 763-781 | 646-664 | CAGCCUGCUGCUCCACGUGUU | 1227 | CACGUGGAGCAGCAGGCUGUU | 2730 |
| D-2223 | 764-782 | 647-665 | AGCCUGCUGCUCCACGUGAUU | 1228 | UCACGUGGAGCAGCAGGCUUU | 2731 |
| D-2224 | 765-783 | 648-666 | GCCUGCUGCUCCACGUGAAUU | 1229 | UUCACGUGGAGCAGCAGGCUU | 2732 |
| D-2225 | 766-784 | 649-667 | CCUGCUGCUCCACGUGAAGUU | 1230 | CUUCACGUGGAGCAGCAGGUU | 2733 |
| D-2226 | 767-785 | 650-668 | CUGCUGCUCCACGUGAAGCUU | 1231 | GCUUCACGUGGAGCAGCAGUU | 2734 |
| D-2227 | 768-786 | 651-669 | UGCUGCUCCACGUGAAGCAUU | 1232 | UGCUUCACGUGGAGCAGCAUU | 2735 |
| D-2228 | 76-94 | 76-94 | CAGAGGCAACCCAUCCCCCUU | 1233 | GGGGGAUGGGUUGCCUCUGUU | 2736 |
| D-2229 | 769-787 | 652-670 | GCUGCUCCACGUGAAGCAGUU | 1234 | CUGCUUCACGUGGAGCAGCUU | 2737 |
| D-2230 | 770-788 | 653-671 | CUGCUCCACGUGAAGCAGUUU | 1235 | ACUGCUUCACGUGGAGCAGUU | 2738 |
| D-2231 | 771-789 | 654-672 | UGCUCCACGUGAAGCAGUUUU | 1236 | AACUGCUUCACGUGGAGCAUU | 2739 |
| D-2232 | 772-790 | 655-673 | GCUCCACGUGAAGCAGUUCUU | 1237 | GAACUGCUUCACGUGGAGCUU | 2740 |
| D-2233 | 773-791 | 656-674 | CUCCACGUGAAGCAGUUCGUU | 1238 | CGAACUGCUUCACGUGGAGUU | 2741 |
| D-2234 | 774-792 | 657-675 | UCCACGUGAAGCAGUUCGUUU | 1239 | ACGAACUGCUUCACGUGGAUU | 2742 |
| D-2235 | 775-793 | 658-676 | CCACGUGAAGCAGUUCGUGUU | 1240 | CACGAACUGCUUCACGUGGUU | 2743 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2236 | 776-794 | 659-677 | CACGUGAAGCAGUUCGUGUUU | 1241 | ACACGAACUGCUUCACGUGUU | 2744 |
| D-2237 | 777-795 | 660-678 | ACGUGAAGCAGUUCGUGUCUU | 1242 | GACACGAACUGCUUCACGUUU | 2745 |
| D-2238 | 778-796 | 661-679 | CGUGAAGCAGUUCGUGUCUUU | 1243 | AGACACGAACUGCUUCACGUU | 2746 |
| D-2239 | 77-95 | 77-95 | AGAGGCAACCCAUCCCCCAUU | 1244 | UGGGGGAUGGGUUGCCUCUUU | 2747 |
| D-2240 | 779-797 | 662-680 | GUGAAGCAGUUCGUGUCUGUU | 1245 | CAGACACGAACUGCUUCACUU | 2748 |
| D-2241 | 780-798 | 663-681 | UGAAGCAGUUCGUGUCUGAUU | 1246 | UCAGACACGAACUGCUUCAUU | 2749 |
| D-2242 | 781-799 | 664-682 | GAAGCAGUUCGUGUCUGACUU | 1247 | GUCAGACACGAACUGCUUCUU | 2750 |
| D-2243 | 782-800 | 665-683 | AAGCAGUUCGUGUCUGACCUU | 1248 | GGUCAGACACGAACUGCUUUU | 2751 |
| D-2244 | 783-801 | 666-684 | AGCAGUUCGUGUCUGACCUUU | 1249 | AGGUCAGACACGAACUGCUUU | 2752 |
| D-2245 | 784-802 | 667-685 | GCAGUUCGUGUCUGACCUGUU | 1250 | CAGGUCAGACACGAACUGCUU | 2753 |
| D-2246 | 785-803 | 668-686 | CAGUUCGUGUCUGACCUGCUU | 1251 | GCAGGUCAGACACGAACUGUU | 2754 |
| D-2247 | 786-804 | 669-687 | AGUUCGUGUCUGACCUGCGUU | 1252 | CGCAGGUCAGACACGAACUUU | 2755 |
| D-2248 | 787-805 | 670-688 | GUUCGUGUCUGACCUGCGGUU | 1253 | CCGCAGGUCAGACACGAACUU | 2756 |
| D-2249 | 788-806 | 671-689 | UUCGUGUCUGACCUGCGGAUU | 1254 | UCCGCAGGUCAGACACGAAUU | 2757 |
| D-2250 | 78-96 | 78-96 | GAGGCAACCCAUCCCCCACUU | 1255 | GUGGGGGAUGGGUUGCCUCUU | 2758 |
| D-2251 | 789-807 | 672-690 | UCGUGUCUGACCUGCGGAGUU | 1256 | CUCCGCAGGUCAGACACGAUU | 2759 |
| D-2252 | 790-808 | 673-691 | CGUGUCUGACCUGCGGAGCUU | 1257 | GCUCCGCAGGUCAGACACGUU | 2760 |
| D-2253 | 791-809 | 674-692 | GUGUCUGACCUGCGGAGCCUU | 1258 | GGCUCCGCAGGUCAGACACUU | 2761 |
| D-2254 | 792-810 | 675-693 | UGUCUGACCUGCGGAGCCUUU | 1259 | AGGCUCCGCAGGUCAGACAUU | 2762 |
| D-2255 | 793-811 | 676-694 | GUCUGACCUGCGGAGCCUGUU | 1260 | CAGGCUCCGCAGGUCAGACUU | 2763 |
| D-2256 | 794-812 | 677-695 | UCUGACCUGCGGAGCCUGAUU | 1261 | UCAGGCUCCGCAGGUCAGAUU | 2764 |
| D-2257 | 795-813 | 678-696 | CUGACCUGCGGAGCCUGAGUU | 1262 | CUCAGGCUCCGCAGGUCAGUU | 2765 |
| D-2258 | 796-814 | 679-697 | UGACCUGCGGAGCCUGAGCUU | 1263 | GCUCAGGCUCCGCAGGUCAUU | 2766 |
| D-2259 | 797-815 | 680-698 | GACCUGCGGAGCCUGAGCUUU | 1264 | AGCUCAGGCUCCGCAGGUCUU | 2767 |
| D-2260 | 798-816 | 681-699 | ACCUGCGGAGCCUGAGCUGUU | 1265 | CAGCUCAGGCUCCGCAGGUUU | 2768 |
| D-2261 | 79-97 | 79-97 | AGGCAACCCAUCCCCCACUUU | 1266 | AGUGGGGGAUGGGUUGCCUUU | 2769 |
| D-2262 | 799-817 | 682-700 | CCUGCGGAGCCUGAGCUGUUU | 1267 | ACAGCUCAGGCUCCGCAGGUU | 2770 |
| D-2263 | 800-818 | 683-701 | CUGCGGAGCCUGAGCUGUCUU | 1268 | GACAGCUCAGGCUCCGCAGUU | 2771 |
| D-2264 | 801-819 | 684-702 | UGCGGAGCCUGAGCUGUCAUU | 1269 | UGACAGCUCAGGCUCCGCAUU | 2772 |
| D-2265 | 802-820 | 685-703 | GCGGAGCCUGAGCUGUCAGUU | 1270 | CUGACAGCUCAGGCUCCGCUU | 2773 |
| D-2266 | 803-821 | 686-704 | CGGAGCCUGAGCUGUCAGAUU | 1271 | UCUGACAGCUCAGGCUCCGUU | 2774 |
| D-2267 | 804-822 | 687-705 | GGAGCCUGAGCUGUCAGAUUU | 1272 | AUCUGACAGCUCAGGCUCCUU | 2775 |
| D-2268 | 805-823 | 688-706 | GAGCCUGAGCUGUCAGAUGUU | 1273 | CAUCUGACAGCUCAGGCUCUU | 2776 |
| D-2269 | 806-824 | 689-707 | AGCCUGAGCUGUCAGAUGGUU | 1274 | CCAUCUGACAGCUCAGGCUUU | 2777 |
| D-2270 | 807-825 | 690-708 | GCCUGAGCUGUCAGAUGGCUU | 1275 | GCCAUCUGACAGCUCAGGCUU | 2778 |
| D-2271 | 808-826 | 691-709 | CCUGAGCUGUCAGAUGGCGUU | 1276 | CGCCAUCUGACAGCUCAGGUU | 2779 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2272 | 80-98 | 80-98 | GGCAACCCAUCCCCCACUCUU | 1277 | GAGUGGGGGAUGGGUUGCCUU | 2780 |
| D-2273 | 809-827 | 692-710 | CUGAGCUGUCAGAUGGCGGUU | 1278 | CCGCCAUCUGACAGCUCAGUU | 2781 |
| D-2274 | 810-828 | 693-711 | UGAGCUGUCAGAUGGCGGCUU | 1279 | GCCGCCAUCUGACAGCUCAUU | 2782 |
| D-2275 | 811-829 | 694-712 | GAGCUGUCAGAUGGCGGCGUU | 1280 | CGCCGCCAUCUGACAGCUCUU | 2783 |
| D-2276 | 812-830 | 695-713 | AGCUGUCAGAUGGCGGCGCUU | 1281 | GCGCCGCCAUCUGACAGCUUU | 2784 |
| D-2277 | 813-831 | 696-714 | GCUGUCAGAUGGCGGCGCUUU | 1282 | AGCGCCGCCAUCUGACAGCUU | 2785 |
| D-2278 | 814-832 | 697-715 | CUGUCAGAUGGCGGCGCUCUU | 1283 | GAGCGCCGCCAUCUGACAGUU | 2786 |
| D-2279 | 815-833 | 698-716 | UGUCAGAUGGCGGCGCUCCUU | 1284 | GGAGCGCCGCCAUCUGACAUU | 2787 |
| D-2280 | 816-834 | 699-717 | GUCAGAUGGCGGCGCUCCAUU | 1285 | UGGAGCGCCGCCAUCUGACUU | 2788 |
| D-2281 | 817-835 | 700-718 | UCAGAUGGCGGCGCUCCAGUU | 1286 | CUGGAGCGCCGCCAUCUGAUU | 2789 |
| D-2282 | 818-836 | 701-719 | CAGAUGGCGGCGCUCCAGGUU | 1287 | CCUGGAGCGCCGCCAUCUGUU | 2790 |
| D-2283 | 819-837 | 702-720 | AGAUGGCGGCGCUCCAGGGUU | 1288 | CCCUGGAGCGCCGCCAUCUUU | 2791 |
| D-2284 | 81-99 | 81-99 | GCAACCCAUCCCCCACUCCUU | 1289 | GGAGUGGGGGAUGGGUUGCUU | 2792 |
| D-2285 | 820-838 | 703-721 | GAUGGCGGCGCUCCAGGGCUU | 1290 | GCCCUGGAGCGCCGCCAUCUU | 2793 |
| D-2286 | 82-100 | 82-100 | CAACCCAUCCCCCACUCCCUU | 1291 | GGGAGUGGGGGAUGGGUUGUU | 2794 |
| D-2287 | 821-839 | 704-722 | AUGGCGGCGCUCCAGGGCAUU | 1292 | UGCCCUGGAGCGCCGCCAUUU | 2795 |
| D-2288 | 822-840 | 705-723 | UGGCGGCGCUCCAGGGCAAUU | 1293 | UUGCCCUGGAGCGCCGCCAUU | 2796 |
| D-2289 | 823-841 | 706-724 | GGCGGCGCUCCAGGGCAAUUU | 1294 | AUUGCCCUGGAGCGCCGCCUU | 2797 |
| D-2290 | 824-842 | 707-725 | GCGGCGCUCCAGGGCAAUGUU | 1295 | CAUUGCCCUGGAGCGCCGCUU | 2798 |
| D-2291 | 825-843 | 708-726 | CGGCGCUCCAGGGCAAUGGUU | 1296 | CCAUUGCCCUGGAGCGCCGUU | 2799 |
| D-2292 | 8-26 | 8-26 | GGUGCACGGAAGAGUGAGGUU | 1297 | CCUCACUCUUCCGUGCACCUU | 2800 |
| D-2293 | 826-844 | 709-727 | GGCGCUCCAGGGCAAUGGCUU | 1298 | GCCAUUGCCCUGGAGCGCCUU | 2801 |
| D-2294 | 827-845 | 710-728 | GCGCUCCAGGGCAAUGGCUUU | 1299 | AGCCAUUGCCCUGGAGCGCUU | 2802 |
| D-2295 | 828-846 | 711-729 | CGCUCCAGGGCAAUGGCUCUU | 1300 | GAGCCAUUGCCCUGGAGCGUU | 2803 |
| D-2296 | 829-847 | 712-730 | GCUCCAGGGCAAUGGCUCAUU | 1301 | UGAGCCAUUGCCCUGGAGCUU | 2804 |
| D-2297 | 830-848 | 713-731 | CUCCAGGGCAAUGGCUCAGUU | 1302 | CUGAGCCAUUGCCCUGGAGUU | 2805 |
| D-2298 | 83-101 | 83-101 | AACCCAUCCCCCACUCCCAUU | 1303 | UGGGAGUGGGGGAUGGGUUUU | 2806 |
| D-2299 | 831-849 | 714-732 | UCCAGGGCAAUGGCUCAGAUU | 1304 | UCUGAGCCAUUGCCCUGGAUU | 2807 |
| D-2300 | 832-850 | 715-733 | CCAGGGCAAUGGCUCAGAAUU | 1305 | UUCUGAGCCAUUGCCCUGGUU | 2808 |
| D-2301 | 833-851 | 716-734 | CAGGGCAAUGGCUCAGAAAUU | 1306 | UUUCUGAGCCAUUGCCCUGUU | 2809 |
| D-2302 | 834-852 | 717-735 | AGGGCAAUGGCUCAGAAAGUU | 1307 | CUUUCUGAGCCAUUGCCCUUU | 2810 |
| D-2303 | 835-853 | 718-736 | GGGCAAUGGCUCAGAAAGGUU | 1308 | CCUUUCUGAGCCAUUGCCCUU | 2811 |
| D-2304 | 836-854 | 719-737 | GGCAAUGGCUCAGAAAGGAUU | 1309 | UCCUUUCUGAGCCAUUGCCUU | 2812 |
| D-2305 | 837-855 | 720-738 | GCAAUGGCUCAGAAAGGACUU | 1310 | GUCCUUUCUGAGCCAUUGCUU | 2813 |
| D-2306 | 838-856 | 721-739 | CAAUGGCUCAGAAAGGACCUU | 1311 | GGUCCUUUCUGAGCCAUUGUU | 2814 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-2307 | 839-857 | 722-740 | AAUGGCUCAGAAAGGACCUUU | 1312 | AGGUCCUUUCUGAGCCAUUUU | 2815 |
| D-2308 | 840-858 | 723-741 | AUGGCUCAGAAAGGACCUGUU | 1313 | CAGGUCCUUUCUGAGCCAUUU | 2816 |
| D-2309 | 84-102 | 84-102 | ACCCAUCCCCCACUCCCACUU | 1314 | GUGGGAGUGGGGGAUGGGUUU | 2817 |
| D-2310 | 841-859 | 724-742 | UGGCUCAGAAAGGACCUGCUU | 1315 | GCAGGUCCUUUCUGAGCCAUU | 2818 |
| D-2311 | 842-860 | 725-743 | GGCUCAGAAAGGACCUGCUUU | 1316 | AGCAGGUCCUUUCUGAGCCUU | 2819 |
| D-2312 | 843-861 | 726-744 | GCUCAGAAAGGACCUGCUGUU | 1317 | CAGCAGGUCCUUUCUGAGCUU | 2820 |
| D-2313 | 844-862 | 727-745 | CUCAGAAAGGACCUGCUGCUU | 1318 | GCAGCAGGUCCUUUCUGAGUU | 2821 |
| D-2314 | 845-863 | 728-746 | UCAGAAAGGACCUGCUGCCUU | 1319 | GGCAGCAGGUCCUUUCUGAUU | 2822 |
| D-2315 | 846-864 | 729-747 | CAGAAAGGACCUGCUGCCCUU | 1320 | GGGCAGCAGGUCCUUUCUGUU | 2823 |
| D-2316 | 847-865 | 730-748 | AGAAAGGACCUGCUGCCCGUU | 1321 | CGGGCAGCAGGUCCUUUCUUU | 2824 |
| D-2317 | 848-866 | 731-749 | GAAAGGACCUGCUGCCCGGUU | 1322 | CCGGGCAGCAGGUCCUUUCUU | 2825 |
| D-2318 | 849-867 | 732-750 | AAAGGACCUGCUGCCCGGUUU | 1323 | ACCGGGCAGCAGGUCCUUUUU | 2826 |
| D-2319 | 850-868 | 733-751 | AAGGACCUGCUGCCCGGUCUU | 1324 | GACCGGGCAGCAGGUCCUUUU | 2827 |
| D-2320 | 85-103 | 85-103 | CCCAUCCCCCACUCCCACCUU | 1325 | GGUGGGAGUGGGGGAUGGGUU | 2828 |
| D-2321 | 851-869 | 734-752 | AGGACCUGCUGCCCGGUCAUU | 1326 | UGACCGGGCAGCAGGUCCUUU | 2829 |
| D-2322 | 852-870 | 735-753 | GGACCUGCUGCCCGGUCAAUU | 1327 | UUGACCGGGCAGCAGGUCCUU | 2830 |
| D-2323 | 853-871 | 736-754 | GACCUGCUGCCCGGUCAACUU | 1328 | GUUGACCGGGCAGCAGGUCUU | 2831 |
| D-2324 | 854-872 | 737-755 | ACCUGCUGCCCGGUCAACUUU | 1329 | AGUUGACCGGGCAGCAGGUUU | 2832 |
| D-2325 | 855-873 | 738-756 | CCUGCUGCCCGGUCAACUGUU | 1330 | CAGUUGACCGGGCAGCAGGUU | 2833 |
| D-2326 | 856-874 | 739-757 | CUGCUGCCCGGUCAACUGGUU | 1331 | CCAGUUGACCGGGCAGCAGUU | 2834 |
| D-2327 | 857-875 | 740-758 | UGCUGCCCGGUCAACUGGGUU | 1332 | CCCAGUUGACCGGGCAGCAUU | 2835 |
| D-2328 | 858-876 | 741-759 | GCUGCCCGGUCAACUGGGUUU | 1333 | ACCCAGUUGACCGGGCAGCUU | 2836 |
| D-2329 | 859-877 | 742-760 | CUGCCCGGUCAACUGGGUGUU | 1334 | CACCCAGUUGACCGGGCAGUU | 2837 |
| D-2330 | 860-878 | 743-761 | UGCCCGGUCAACUGGGUGGUU | 1335 | CCACCCAGUUGACCGGGCAUU | 2838 |
| D-2331 | 86-104 | 86-104 | CCAUCCCCCACUCCCACCCUU | 1336 | GGGUGGGAGUGGGGGAUGGUU | 2839 |
| D-2332 | 861-879 | 744-762 | GCCCGGUCAACUGGGUGGAUU | 1337 | UCCACCCAGUUGACCGGGCUU | 2840 |
| D-2333 | 862-880 | 745-763 | CCCGGUCAACUGGGUGGAGUU | 1338 | CUCCACCCAGUUGACCGGGUU | 2841 |
| D-2334 | 863-881 | 746-764 | CCGGUCAACUGGGUGGAGCUU | 1339 | GCUCCACCCAGUUGACCGGUU | 2842 |
| D-2335 | 864-882 | 747-765 | CGGUCAACUGGGUGGAGCAUU | 1340 | UGCUCCACCCAGUUGACCGUU | 2843 |
| D-2336 | 865-883 | 748-766 | GGUCAACUGGGUGGAGCACUU | 1341 | GUGCUCCACCCAGUUGACCUU | 2844 |
| D-2337 | 866-884 | 749-767 | GUCAACUGGGUGGAGCACGUU | 1342 | CGUGCUCCACCCAGUUGACUU | 2845 |
| D-2338 | 867-885 | 750-768 | UCAACUGGGUGGAGCACGAUU | 1343 | UCGUGCUCCACCCAGUUGAUU | 2846 |
| D-2339 | 868-886 | 751-769 | CAACUGGGUGGAGCACGAGUU | 1344 | CUCGUGCUCCACCCAGUUGUU | 2847 |
| D-2340 | 869-887 | 752-770 | AACUGGGUGGAGCACGAGCUU | 1345 | GCUCGUGCUCCACCCAGUUUU | 2848 |
| D-2341 | 870-888 | 753-771 | ACUGGGUGGAGCACGAGCGUU | 1346 | CGCUCGUGCUCCACCCAGUUU | 2849 |
| D-2342 | 87-105 | 87-105 | CAUCCCCCACUCCCACCCCUU | 1347 | GGGGUGGGAGUGGGGGAUGUU | 2850 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2343 | 871-889 | 754-772 | CUGGGUGGAGCACGAGCGCUU | 1348 | GCGCUCGUGCUCCACCCAGUU | 2851 |
| D-2344 | 872-890 | 755-773 | UGGGUGGAGCACGAGCGCAUU | 1349 | UGCGCUCGUGCUCCACCCAUU | 2852 |
| D-2345 | 873-891 | 756-774 | GGGUGGAGCACGAGCGCAGUU | 1350 | CUGCGCUCGUGCUCCACCCUU | 2853 |
| D-2346 | 874-892 | 757-775 | GGUGGAGCACGAGCGCAGCUU | 1351 | GCUGCGCUCGUGCUCCACCUU | 2854 |
| D-2347 | 875-893 | 758-776 | GUGGAGCACGAGCGCAGCUUU | 1352 | AGCUGCGCUCGUGCUCCACUU | 2855 |
| D-2348 | 876-894 | 759-777 | UGGAGCACGAGCGCAGCUGUU | 1353 | CAGCUGCGCUCGUGCUCCAUU | 2856 |
| D-2349 | 877-895 | 760-778 | GGAGCACGAGCGCAGCUGCUU | 1354 | GCAGCUGCGCUCGUGCUCCUU | 2857 |
| D-2350 | 878-896 | 761-779 | GAGCACGAGCGCAGCUGCUUU | 1355 | AGCAGCUGCGCUCGUGCUCUU | 2858 |
| D-2351 | 879-897 | 762-780 | AGCACGAGCGCAGCUGCUAUU | 1356 | UAGCAGCUGCGCUCGUGCUUU | 2859 |
| D-2352 | 880-898 | 763-781 | GCACGAGCGCAGCUGCUACUU | 1357 | GUAGCAGCUGCGCUCGUGCUU | 2860 |
| D-2353 | 88-106 | 88-106 | AUCCCCCACUCCCACCCCCUU | 1358 | GGGGGUGGGAGUGGGGGAUUU | 2861 |
| D-2354 | 881-899 | 764-782 | CACGAGCGCAGCUGCUACUUU | 1359 | AGUAGCAGCUGCGCUCGUGUU | 2862 |
| D-2355 | 882-900 | 765-783 | ACGAGCGCAGCUGCUACUGUU | 1360 | CAGUAGCAGCUGCGCUCGUUU | 2863 |
| D-2356 | 883-901 | 766-784 | CGAGCGCAGCUGCUACUGGUU | 1361 | CCAGUAGCAGCUGCGCUCGUU | 2864 |
| D-2357 | 884-902 | 767-785 | GAGCGCAGCUGCUACUGGUUU | 1362 | ACCAGUAGCAGCUGCGCUCUU | 2865 |
| D-2358 | 885-903 | 768-786 | AGCGCAGCUGCUACUGGUUUU | 1363 | AACCAGUAGCAGCUGCGCUUU | 2866 |
| D-2359 | 886-904 | 769-787 | GCGCAGCUGCUACUGGUUCUU | 1364 | GAACCAGUAGCAGCUGCGCUU | 2867 |
| D-2360 | 887-905 | 770-788 | CGCAGCUGCUACUGGUUCUUU | 1365 | AGAACCAGUAGCAGCUGCGUU | 2868 |
| D-2361 | 888-906 | 771-789 | GCAGCUGCUACUGGUUCUCUU | 1366 | GAGAACCAGUAGCAGCUGCUU | 2869 |
| D-2362 | 889-907 | 772-790 | CAGCUGCUACUGGUUCUCUUU | 1367 | AGAGAACCAGUAGCAGCUGUU | 2870 |
| D-2363 | 890-908 | 773-791 | AGCUGCUACUGGUUCUCUCUU | 1368 | GAGAGAACCAGUAGCAGCUUU | 2871 |
| D-2364 | 89-107 | 89-107 | UCCCCCACUCCCACCCCCAUU | 1369 | UGGGGGUGGGAGUGGGGGAUU | 2872 |
| D-2365 | 891-909 | 774-792 | GCUGCUACUGGUUCUCUCGUU | 1370 | CGAGAGAACCAGUAGCAGCUU | 2873 |
| D-2366 | 892-910 | 775-793 | CUGCUACUGGUUCUCUCGCUU | 1371 | GCGAGAGAACCAGUAGCAGUU | 2874 |
| D-2367 | 893-911 | 776-794 | UGCUACUGGUUCUCUCGCUUU | 1372 | AGCGAGAGAACCAGUAGCAUU | 2875 |
| D-2368 | 894-912 | 777-795 | GCUACUGGUUCUCUCGCUCUU | 1373 | GAGCGAGAGAACCAGUAGCUU | 2876 |
| D-2369 | 895-913 | 778-796 | CUACUGGUUCUCUCGCUCCUU | 1374 | GGAGCGAGAGAACCAGUAGUU | 2877 |
| D-2370 | 896-914 | 779-797 | UACUGGUUCUCUCGCUCCGUU | 1375 | CGGAGCGAGAGAACCAGUAUU | 2878 |
| D-2371 | 897-915 | 780-798 | ACUGGUUCUCUCGCUCCGGUU | 1376 | CCGGAGCGAGAGAACCAGUUU | 2879 |
| D-2372 | 898-916 | 781-799 | CUGGUUCUCUCGCUCCGGGUU | 1377 | CCCGGAGCGAGAGAACCAGUU | 2880 |
| D-2373 | 899-917 | 782-800 | UGGUUCUCUCGCUCCGGGAUU | 1378 | UCCCGGAGCGAGAGAACCAUU | 2881 |
| D-2374 | 900-918 | 783-801 | GGUUCUCUCGCUCCGGGAAUU | 1379 | UUCCCGGAGCGAGAGAACCUU | 2882 |
| D-2375 | 90-108 | 90-108 | CCCCCACUCCCACCCCCACUU | 1380 | GUGGGGGUGGGAGUGGGGGUU | 2883 |
| D-2376 | 901-919 | 784-802 | GUUCUCUCGCUCCGGGAAGUU | 1381 | CUUCCCGGAGCGAGAGAACUU | 2884 |
| D-2377 | 902-920 | 785-803 | UUCUCUCGCUCCGGGAAGGUU | 1382 | CCUUCCCGGAGCGAGAGAAUU | 2885 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
|---|---|---|---|---|---|---|
| D-2378 | 903-921 | 786-804 | UCUCUCGCUCCGGGAAGGCUU | 1383 | GCCUUCCCGGAGCGAGAGAUU | 2886 |
| D-2379 | 904-922 | 787-805 | CUCUCGCUCCGGGAAGGCCUU | 1384 | GGCCUUCCCGGAGCGAGAGUU | 2887 |
| D-2380 | 905-923 | 788-806 | UCUCGCUCCGGGAAGGCCUUU | 1385 | AGGCCUUCCCGGAGCGAGAUU | 2888 |
| D-2381 | 906-924 | 789-807 | CUCGCUCCGGGAAGGCCUGUU | 1386 | CAGGCCUUCCCGGAGCGAGUU | 2889 |
| D-2382 | 907-925 | 790-808 | UCGCUCCGGGAAGGCCUGGUU | 1387 | CCAGGCCUUCCCGGAGCGAUU | 2890 |
| D-2383 | 908-926 | 791-809 | CGCUCCGGGAAGGCCUGGGUU | 1388 | CCCAGGCCUUCCCGGAGCGUU | 2891 |
| D-2384 | 909-927 | 792-810 | GCUCCGGGAAGGCCUGGGCUU | 1389 | GCCCAGGCCUUCCCGGAGCUU | 2892 |
| D-2385 | 910-928 | 793-811 | CUCCGGGAAGGCCUGGGCUUU | 1390 | AGCCCAGGCCUUCCCGGAGUU | 2893 |
| D-2386 | 91-109 | 91-109 | CCCCACUCCCACCCCCACAUU | 1391 | UGUGGGGGUGGGAGUGGGGUU | 2894 |
| D-2387 | 911-929 | 794-812 | UCCGGGAAGGCCUGGGCUGUU | 1392 | CAGCCCAGGCCUUCCCGGAUU | 2895 |
| D-2388 | 912-930 | 795-813 | CCGGGAAGGCCUGGGCUGAUU | 1393 | UCAGCCCAGGCCUUCCCGGUU | 2896 |
| D-2389 | 913-931 | 796-814 | CGGGAAGGCCUGGGCUGACUU | 1394 | GUCAGCCCAGGCCUUCCCGUU | 2897 |
| D-2390 | 914-932 | 797-815 | GGGAAGGCCUGGGCUGACGUU | 1395 | CGUCAGCCCAGGCCUUCCCUU | 2898 |
| D-2391 | 915-933 | 798-816 | GGAAGGCCUGGGCUGACGCUU | 1396 | GCGUCAGCCCAGGCCUUCCUU | 2899 |
| D-2392 | 916-934 | 799-817 | GAAGGCCUGGGCUGACGCCUU | 1397 | GGCGUCAGCCCAGGCCUUCUU | 2900 |
| D-2393 | 917-935 | 800-818 | AAGGCCUGGGCUGACGCCGUU | 1398 | CGGCGUCAGCCCAGGCCUUUU | 2901 |
| D-2394 | 918-936 | 801-819 | AGGCCUGGGCUGACGCCGAUU | 1399 | UCGGCGUCAGCCCAGGCCUUU | 2902 |
| D-2395 | 919-937 | 802-820 | GGCCUGGGCUGACGCCGACUU | 1400 | GUCGGCGUCAGCCCAGGCCUU | 2903 |
| D-2396 | 920-938 | 803-821 | GCCUGGGCUGACGCCGACAUU | 1401 | UGUCGGCGUCAGCCCAGGCUU | 2904 |
| D-2397 | 92-110 | 92-110 | CCCACUCCCACCCCCACACUU | 1402 | GUGUGGGGGUGGGAGUGGGUU | 2905 |
| D-2398 | 921-939 | 804-822 | CCUGGGCUGACGCCGACAAUU | 1403 | UUGUCGGCGUCAGCCCAGGUU | 2906 |
| D-2399 | 922-940 | 805-823 | CUGGGCUGACGCCGACAACUU | 1404 | GUUGUCGGCGUCAGCCCAGUU | 2907 |
| D-2400 | 923-941 | 806-824 | UGGGCUGACGCCGACAACUUU | 1405 | AGUUGUCGGCGUCAGCCCAUU | 2908 |
| D-2401 | 924-942 | 807-825 | GGGCUGACGCCGACAACUAUU | 1406 | UAGUUGUCGGCGUCAGCCCUU | 2909 |
| D-2402 | 925-943 | 808-826 | GGCUGACGCCGACAACUACUU | 1407 | GUAGUUGUCGGCGUCAGCCUU | 2910 |
| D-2403 | 926-944 | 809-827 | GCUGACGCCGACAACUACUUU | 1408 | AGUAGUUGUCGGCGUCAGCUU | 2911 |
| D-2404 | 9-27 | 9-27 | GUGCACGGAAGAGUGAGGUUU | 1409 | ACCUCACUCUUCCGUGCACUU | 2912 |
| D-2405 | 927-945 | 810-828 | CUGACGCCGACAACUACUGUU | 1410 | CAGUAGUUGUCGGCGUCAGUU | 2913 |
| D-2406 | 928-946 | 811-829 | UGACGCCGACAACUACUGCUU | 1411 | GCAGUAGUUGUCGGCGUCAUU | 2914 |
| D-2407 | 929-947 | 812-830 | GACGCCGACAACUACUGCCUU | 1412 | GGCAGUAGUUGUCGGCGUCUU | 2915 |
| D-2408 | 930-948 | 813-831 | ACGCCGACAACUACUGCCGUU | 1413 | CGGCAGUAGUUGUCGGCGUUU | 2916 |
| D-2409 | 93-111 | 93-111 | CCACUCCCACCCCCACACUUU | 1414 | AGUGUGGGGGUGGGAGUGGUU | 2917 |
| D-2410 | 931-949 | 814-832 | CGCCGACAACUACUGCCGGUU | 1415 | CCGGCAGUAGUUGUCGGCGUU | 2918 |
| D-2411 | 932-950 | 815-833 | GCCGACAACUACUGCCGGCUU | 1416 | GCCGGCAGUAGUUGUCGGCUU | 2919 |
| D-2412 | 933-951 | 816-834 | CCGACAACUACUGCCGGCUUU | 1417 | AGCCGGCAGUAGUUGUCGGUU | 2920 |
| D-2413 | 934-952 | 817-835 | CGACAACUACUGCCGGCUGUU | 1418 | CAGCCGGCAGUAGUUGUCGUU | 2921 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-2414 | 935-953 | 818-836 | GACAACUACUGCCGGCUGGUU | 1419 | CCAGCCGGCAGUAGUUGUCUU | 2922 |
| D-2415 | 936-954 | 819-837 | ACAACUACUGCCGGCUGGAUU | 1420 | UCCAGCCGGCAGUAGUUGUUU | 2923 |
| D-2416 | 937-955 | 820-838 | CAACUACUGCCGGCUGGAGUU | 1421 | CUCCAGCCGGCAGUAGUUGUU | 2924 |
| D-2417 | 938-956 | 821-839 | AACUACUGCCGGCUGGAGGUU | 1422 | CCUCCAGCCGGCAGUAGUUUU | 2925 |
| D-2418 | 939-957 | 822-840 | ACUACUGCCGGCUGGAGGAUU | 1423 | UCCUCCAGCCGGCAGUAGUUU | 2926 |
| D-2419 | 940-958 | 823-841 | CUACUGCCGGCUGGAGGACUU | 1424 | GUCCUCCAGCCGGCAGUAGUU | 2927 |
| D-2420 | 94-112 | 94-112 | CACUCCCACCCCCACACUCUU | 1425 | GAGUGUGGGGGUGGGAGUGUU | 2928 |
| D-2421 | 941-959 | 824-842 | UACUGCCGGCUGGAGGACGUU | 1426 | CGUCCUCCAGCCGGCAGUAUU | 2929 |
| D-2422 | 942-960 | 825-843 | ACUGCCGGCUGGAGGACGCUU | 1427 | GCGUCCUCCAGCCGGCAGUUU | 2930 |
| D-2423 | 943-961 | 826-844 | CUGCCGGCUGGAGGACGCGUU | 1428 | CGCGUCCUCCAGCCGGCAGUU | 2931 |
| D-2424 | 944-962 | 827-845 | UGCCGGCUGGAGGACGCGCUU | 1429 | GCGCGUCCUCCAGCCGGCAUU | 2932 |
| D-2425 | 945-963 | 828-846 | GCCGGCUGGAGGACGCGCAUU | 1430 | UGCGCGUCCUCCAGCCGGCUU | 2933 |
| D-2426 | 946-964 | 829-847 | CCGGCUGGAGGACGCGCACUU | 1431 | GUGCGCGUCCUCCAGCCGGUU | 2934 |
| D-2427 | 947-965 | 830-848 | CGGCUGGAGGACGCGCACCUU | 1432 | GGUGCGCGUCCUCCAGCCGUU | 2935 |
| D-2428 | 948-966 | 831-849 | GGCUGGAGGACGCGCACCUUU | 1433 | AGGUGCGCGUCCUCCAGCCUU | 2936 |
| D-2429 | 949-967 | 832-850 | GCUGGAGGACGCGCACCUGUU | 1434 | CAGGUGCGCGUCCUCCAGCUU | 2937 |
| D-2430 | 950-968 | 833-851 | CUGGAGGACGCGCACCUGGUU | 1435 | CCAGGUGCGCGUCCUCCAGUU | 2938 |
| D-2431 | 95-113 | 95-113 | ACUCCCACCCCCACACUCCUU | 1436 | GGAGUGUGGGGGUGGGAGUUU | 2939 |
| D-2432 | 951-969 | 834-852 | UGGAGGACGCGCACCUGGUUU | 1437 | ACCAGGUGCGCGUCCUCCAUU | 2940 |
| D-2433 | 952-970 | 835-853 | GGAGGACGCGCACCUGGUGUU | 1438 | CACCAGGUGCGCGUCCUCCUU | 2941 |
| D-2434 | 953-971 | 836-854 | GAGGACGCGCACCUGGUGGUU | 1439 | CCACCAGGUGCGCGUCCUCUU | 2942 |
| D-2435 | 954-972 | 837-855 | AGGACGCGCACCUGGUGGUUU | 1440 | ACCACCAGGUGCGCGUCCUUU | 2943 |
| D-2436 | 955-973 | 838-856 | GGACGCGCACCUGGUGGUGUU | 1441 | CACCACCAGGUGCGCGUCCUU | 2944 |
| D-2437 | 956-974 | 839-857 | GACGCGCACCUGGUGGUGGUU | 1442 | CCACCACCAGGUGCGCGUCUU | 2945 |
| D-2438 | 957-975 | 840-858 | ACGCGCACCUGGUGGUGGUUU | 1443 | ACCACCACCAGGUGCGCGUUU | 2946 |
| D-2439 | 958-976 | 841-859 | CGCGCACCUGGUGGUGGUCUU | 1444 | GACCACCACCAGGUGCGCGUU | 2947 |
| D-2440 | 959-977 | 842-860 | GCGCACCUGGUGGUGGUCAUU | 1445 | UGACCACCACCAGGUGCGCUU | 2948 |
| D-2441 | 960-978 | 843-861 | CGCACCUGGUGGUGGUCACUU | 1446 | GUGACCACCACCAGGUGCGUU | 2949 |
| D-2442 | 96-114 | 96-114 | CUCCCACCCCCACACUCCCUU | 1447 | GGGAGUGUGGGGGUGGGAGUU | 2950 |
| D-2443 | 961-979 | 844-862 | GCACCUGGUGGUGGUCACGUU | 1448 | CGUGACCACCACCAGGUGCUU | 2951 |
| D-2444 | 962-980 | 845-863 | CACCUGGUGGUGGUCACGUUU | 1449 | ACGUGACCACCACCAGGUGUU | 2952 |
| D-2445 | 963-981 | 846-864 | ACCUGGUGGUGGUCACGUCUU | 1450 | GACGUGACCACCACCAGGUUU | 2953 |
| D-2446 | 964-982 | 847-865 | CCUGGUGGUGGUCACGUCCUU | 1451 | GGACGUGACCACCACCAGGUU | 2954 |
| D-2447 | 965-983 | 848-866 | CUGGUGGUGGUCACGUCCUUU | 1452 | AGGACGUGACCACCACCAGUU | 2955 |
| D-2448 | 966-984 | 849-867 | UGGUGGUGGUCACGUCCUGUU | 1453 | CAGGACGUGACCACCACCAUU | 2956 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-2449 | 967-985 | 850-868 | GGUGGUGGUCACGUCCUGGUU | 1454 | CCAGGACGUGACCACCACCUU | 2957 |
| D-2450 | 968-986 | 851-869 | GUGGUGGUCACGUCCUGGGUU | 1455 | CCCAGGACGUGACCACCACUU | 2958 |
| D-2451 | 969-987 | 852-870 | UGGUGGUCACGUCCUGGGAUU | 1456 | UCCCAGGACGUGACCACCAUU | 2959 |
| D-2452 | 970-988 | 853-871 | GGUGGUCACGUCCUGGGAGUU | 1457 | CUCCCAGGACGUGACCACCUU | 2960 |
| D-2453 | 97-115 | 97-115 | UCCCACCCCCACACUCCCCUU | 1458 | GGGGAGUGUGGGGGUGGGAUU | 2961 |
| D-2454 | 971-989 | 854-872 | GUGGUCACGUCCUGGGAGGUU | 1459 | CCUCCCAGGACGUGACCACUU | 2962 |
| D-2455 | 972-990 | 855-873 | UGGUCACGUCCUGGGAGGAUU | 1460 | UCCUCCCAGGACGUGACCAUU | 2963 |
| D-2456 | 973-991 | 856-874 | GGUCACGUCCUGGGAGGAGUU | 1461 | CUCCUCCCAGGACGUGACCUU | 2964 |
| D-2457 | 974-992 | 857-875 | GUCACGUCCUGGGAGGAGCUU | 1462 | GCUCCUCCCAGGACGUGACUU | 2965 |
| D-2458 | 975-993 | 858-876 | UCACGUCCUGGGAGGAGCAUU | 1463 | UGCUCCUCCCAGGACGUGAUU | 2966 |
| D-2459 | 976-994 | 859-877 | CACGUCCUGGGAGGAGCAGUU | 1464 | CUGCUCCUCCCAGGACGUGUU | 2967 |
| D-2460 | 977-995 | 860-878 | ACGUCCUGGGAGGAGCAGAUU | 1465 | UCUGCUCCUCCCAGGACGUUU | 2968 |
| D-2461 | 978-996 | 861-879 | CGUCCUGGGAGGAGCAGAAUU | 1466 | UUCUGCUCCUCCCAGGACGUU | 2969 |
| D-2462 | 979-997 | 862-880 | GUCCUGGGAGGAGCAGAAAUU | 1467 | UUUCUGCUCCUCCCAGGACUU | 2970 |
| D-2463 | 980-998 | 863-881 | UCCUGGGAGGAGCAGAAAUUU | 1468 | AUUUCUGCUCCUCCCAGGAUU | 2971 |
| D-2464 | 98-116 | 98-116 | CCCACCCCCACACUCCCCUUU | 1469 | AGGGGAGUGUGGGGGUGGGUU | 2972 |
| D-2465 | 981-999 | 864-882 | CCUGGGAGGAGCAGAAAUUUU | 1470 | AAUUUCUGCUCCUCCCAGGUU | 2973 |
| D-2466 | 982-1000 | 865-883 | CUGGGAGGAGCAGAAAUUUUU | 1471 | AAAUUUCUGCUCCUCCCAGUU | 2974 |
| D-2467 | 983-1001 | 866-884 | UGGGAGGAGCAGAAAUUUGUU | 1472 | CAAAUUUCUGCUCCUCCCAUU | 2975 |
| D-2468 | 984-1002 | 867-885 | GGGAGGAGCAGAAAUUUGUUU | 1473 | ACAAAUUUCUGCUCCUCCCUU | 2976 |
| D-2469 | 985-1003 | 868-886 | GGAGGAGCAGAAAUUUGUCUU | 1474 | GACAAAUUUCUGCUCCUCCUU | 2977 |
| D-2470 | 986-1004 | 869-887 | GAGGAGCAGAAAUUUGUCCUU | 1475 | GGACAAAUUUCUGCUCCUCUU | 2978 |
| D-2471 | 987-1005 | 870-888 | AGGAGCAGAAAUUUGUCCAUU | 1476 | UGGACAAAUUUCUGCUCCUUU | 2979 |
| D-2472 | 988-1006 | 871-889 | GGAGCAGAAAUUUGUCCAGUU | 1477 | CUGGACAAAUUUCUGCUCCUU | 2980 |
| D-2473 | 989-1007 | 872-890 | GAGCAGAAAUUUGUCCAGCUU | 1478 | GCUGGACAAAUUUCUGCUCUU | 2981 |
| D-2474 | 990-1008 | 873-891 | AGCAGAAAUUUGUCCAGCAUU | 1479 | UGCUGGACAAAUUUCUGCUUU | 2982 |
| D-2475 | 991-1009 | 874-892 | GCAGAAAUUUGUCCAGCACUU | 1480 | GUGCUGGACAAAUUUCUGCUU | 2983 |
| D-2476 | 99-117 | 99-117 | CCACCCCCACACUCCCCUAUU | 1481 | UAGGGGAGUGUGGGGGUGGUU | 2984 |
| D-2477 | 992-1010 | 875-893 | CAGAAAUUUGUCCAGCACCUU | 1482 | GGUGCUGGACAAAUUUCUGUU | 2985 |
| D-2478 | 993-1011 | 876-894 | AGAAAUUUGUCCAGCACCAUU | 1483 | UGGUGCUGGACAAAUUUCUUU | 2986 |
| D-2479 | 994-1012 | 877-895 | GAAAUUUGUCCAGCACCACUU | 1484 | GUGGUGCUGGACAAAUUUCUU | 2987 |
| D-2480 | 995-1013 | 878-896 | AAAUUUGUCCAGCACCACAUU | 1485 | UGUGGUGCUGGACAAAUUUUU | 2988 |
| D-2481 | 996-1014 | 879-897 | AAUUUGUCCAGCACCACAUUU | 1486 | AUGUGGUGCUGGACAAAUUUU | 2989 |
| D-2482 | 997-1015 | 880-898 | AUUUGUCCAGCACCACAUAUU | 1487 | UAUGUGGUGCUGGACAAAUUU | 2990 |
| D-2483 | 998-1016 | 881-899 | UUUGUCCAGCACCACAUAGUU | 1488 | CUAUGUGGUGCUGGACAAAUU | 2991 |
| D-2484 | 999-1017 | 882-900 | UUGUCCAGCACCACAUAGGUU | 1489 | CCUAUGUGGUGCUGGACAAUU | 2992 |

TABLE 1-continued

| ASGR1 siRNA Sequences | | | | | | |
|---|---|---|---|---|---|---|
| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: anti-sense |
| D-2485 | — | 453-471 | ACCAUCAGCUCAGAAAAGAUU | 1490 | UCUUUUCUGAGCUGAUGGUUU | 2993 |
| D-2486 | — | 454-472 | CCAUCAGCUCAGAAAAGACUU | 1491 | GUCUUUUCUGAGCUGAUGGUU | 2994 |
| D-2487 | — | 455-473 | CAUCAGCUCAGAAAAGACUUU | 1492 | AGUCUUUUCUGAGCUGAUGUU | 2995 |
| D-2488 | — | 456-474 | AUCAGCUCAGAAAAGACUCUU | 1493 | GAGUCUUUUCUGAGCUGAUUU | 2996 |
| D-2489 | — | 457-475 | UCAGCUCAGAAAAGACUCCUU | 1494 | GGAGUCUUUUCUGAGCUGAUU | 2997 |
| D-2490 | — | 458-476 | CAGCUCAGAAAAGACUCCCUU | 1495 | GGGAGUCUUUUCUGAGCUGUU | 2998 |
| D-2491 | — | 459-477 | AGCUCAGAAAAGACUCCCAUU | 1496 | UGGGAGUCUUUUCUGAGCUUU | 2999 |
| D-2492 | — | 460-478 | GCUCAGAAAAGACUCCCAGUU | 1497 | CUGGGAGUCUUUUCUGAGCUU | 3000 |
| D-2493 | — | 461-479 | CUCAGAAAAGACUCCCAGCUU | 1498 | GCUGGGAGUCUUUUCUGAGUU | 3001 |
| D-2494 | — | 462-480 | UCAGAAAAGACUCCCAGCUUU | 1499 | AGCUGGGAGUCUUUUCUGAUU | 3002 |
| D-2495 | — | 463-481 | CAGAAAAGACUCCCAGCUGUU | 1500 | CAGCUGGGAGUCUUUUCUGUU | 3003 |
| D-2496 | — | 464-482 | AGAAAAGACUCCCAGCUGCUU | 1501 | GCAGCUGGGAGUCUUUUCUUU | 3004 |
| D-2497 | — | 465-483 | GAAAAGACUCCCAGCUGCAUU | 1502 | UGCAGCUGGGAGUCUUUUCUU | 3005 |
| D-2498 | — | 466-484 | AAAAGACUCCCAGCUGCAGUU | 1503 | CUGCAGCUGGGAGUCUUUUUU | 3006 |
| D-2499 | — | 467-485 | AAAGACUCCCAGCUGCAGGUU | 1504 | CCUGCAGCUGGGAGUCUUUUU | 3007 |
| D-2500 | — | 468-486 | AAGACUCCCAGCUGCAGGAUU | 1505 | UCCUGCAGCUGGGAGUCUUUU | 3008 |
| D-2501 | — | 469-487 | AGACUCCCAGCUGCAGGAGUU | 1506 | CUCCUGCAGCUGGGAGUCUUU | 3009 |
| D-2502 | — | 470-488 | GACUCCCAGCUGCAGGAGGUU | 1507 | CCUCCUGCAGCUGGGAGUCUU | 3010 |

Example 2. Efficacy of ASGR1 siRNA Molecules In Vitro

The siRNA molecules in Tier 1 and Tier 2 screening sets were synthesized without chemical modifications. Each siRNA molecule was comprised of a 21 nucleotide sense strand and 21 nucleotide antisense strand that hybridized to form a duplex region of 19 base pairs with a 2 nucleotide overhang at the 3' end of each strand. The efficacy of each of the siRNA molecules in reducing ASGR1 expression was assessed using a 384-well format in vitro immunoassay, which quantifies levels of ASGR1 protein on the cell surface of Hep3B or HepG2 cells.

Transfection complexes of the siRNA molecules and RNAiMax transfection reagent (Life Technologies) in EMEM media (ATCC 30-2003) were prepared in 384-well plates in accordance with manufacturer's recommendations. Human hepatocellular carcinoma Hep3B (ATCC HB-8064) or HepG2 (ATCC HB-8065) cells in EMEM media supplemented with 10% fetal bovine serum and 1% antibiotic/antimycotic were added to each well. Cells were incubated for 4 days at 37° C. and 5% $CO_2$. Four days after siRNA transfection, cells were fixed in formaldehyde, blocked with bovine serum albumin, and subsequently stained with an anti-ASGR1 primary antibody (Amgen clone 7E11, light and heavy chain sequences provided below (SEQ ID NOs: 3 and 4)) for either 1 hour at room temperature or overnight at 4° C. Plates were washed three times with phosphate buffered saline (PBS). Cells were then incubated in the dark for 45 minutes at room temperature with Alexa488-conjugated anti-human IgG secondary antibody and nuclear stain DRAQ5 (ThermoFisher #62251), which was included to assess cell number. Following three PBS washes, the plates were imaged on an Opera Phenix high-content screening system (PerkinElmer) using the 488 and 640 channels to measure anti-ASGR1 antibody staining and nuclear staining, respectively. Data was analyzed using Columbus image analysis software and GeneData Screener software to quantify several measures of ASGR1 protein levels, cell count, and cell morphology on a per cell and per well basis.

Anti-ASGR1 primary antibody light chain amino acid sequence:

```
                                          (SEQ ID NO: 3)
DIQMTQSPSSLSASVGDRVTIACRASQNIISYLNWYQQKPGKAPKFLIYT

ASSLQSGVPSRFSGSGSGTDFTLTISSLQPEDFAIYYCQQTYSTPLTFGG

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC
```

Anti-ASGR1 primary antibody heavy chain amino acid sequence:

(SEQ ID NO: 4)

QVQLVESGGGVVQPGRSLRLSCAASGFTFSSFGMHWVRQAPGKGLEWVAI

IWHDGSNKYYADSVKGRFTISRDNSKNTLYLQMSSLRAEDTAVYYCARDL

SMGGMDVWGQGTTVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCDKTHTCPPCPAPELLGGPSVFLFPPKPKD

TLMISRTPEVTCVVVDVSHEDPEVKFNWYVDGVEVHNAKTKPCEEQYGST

YRCVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK

Activity of each siRNA molecule was measured using a "Normalized Alexa 488 Mean Intensity" readout, which quantifies ASGR1 protein expression based on cell population analysis relative to ASGR1 expression in control cell populations. Cells transfected with non-targeting siRNA duplexes (i.e. siRNAs that do not have a 100% sequence match to any human gene sequences) were used as controls on each plate and a "central reference value" was calculated from these control cells. Specifically, the "central reference value" was the median value of the Alexa 488 intensity of the multiple wells containing cells transfected with non-targeting siRNAs. The "Normalized Alexa 488 Mean Intensity" was calculated for each well as follows. Nuclei and cytoplasm were segmented using the DRAQ5 counterstain. The mean Alexa488 fluorescence intensity for each cell (i.e. the entire cellular region, including cytoplasm and nucleus) was measured. Individual cell values were averaged to produce a mean Alexa 488 intensity value for each well. This mean intensity value was then normalized to the central reference value to arrive at the "Normalized Alexa 488 Mean Intensity" value, which represents an ASGR1 expression measurement as a percent of control. Thus, negative "Normalized Alexa 488 Mean Intensity" values represent a reduced ASGR1 expression relative to control cells. Cell counts as assessed by the DRAQ5 stain were also normalized to cell counts for control cells and thus, represent a cell viability measurement as a percent of control.

The Tier 1 siRNA molecules were tested in duplicate at three different concentrations (0.3 nM, 1.25 nM, and 5 nM) in the in vitro immunoassay in both Hep3B cells and HepG2 cells. The reduction in ASGR1 cell surface expression relative to expression in cells transfected with non-targeting siRNAs in Hep3B cells for each siRNA molecule is shown in Table 2 below. Cell count measurements are also provided. For clarity, the data for the lowest concentration (0.3 nM) and the data for the HepG2 cells are not shown. The data shown in Table 2 are the results from two independent transfections of each siRNA (e.g. Run 1 and Run 2).

TABLE 2

In vitro efficacy of Tier 1 ASGRI siRNA molecules in immunoassay screen

| | Run 1 | | | | Run 2 | | | |
|---|---|---|---|---|---|---|---|---|
| Duplex No. | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-1011 | 16.51 | −51.78 | 0.13 | −14.40 | 25.37 | −51.83 | 3.76 | −28.05 |
| D-1018 | −17.30 | −55.17 | 2.29 | −16.02 | −34.78 | −52.13 | 30.89 | −7.73 |
| D-1024 | −29.00 | −18.51 | −0.82 | 12.30 | 1.97 | 14.82 | 6.60 | 4.61 |
| D-1036 | −46.65 | 10.97 | −10.56 | 7.07 | −18.48 | 71.68 | 1.10 | 12.95 |
| D-1055 | 10.56 | −13.14 | −1.08 | −9.93 | 7.75 | −24.90 | 11.92 | −7.81 |
| D-1063 | 9.47 | −18.69 | −2.54 | −11.47 | −25.16 | −50.11 | −10.17 | −18.86 |
| D-1069 | −20.87 | −41.89 | −4.27 | 3.93 | −11.39 | −28.60 | 12.28 | 7.84 |
| D-1082 | 17.70 | −48.78 | −8.32 | −14.13 | −0.15 | −55.38 | −5.13 | −50.19 |
| D-1089 | −35.75 | −60.09 | −12.25 | −36.42 | −25.97 | −57.46 | −7.24 | −51.34 |
| D-1091 | −18.99 | −31.14 | −13.76 | 5.02 | −27.59 | −20.03 | 3.02 | −6.61 |
| D-1098 | 6.89 | −54.37 | −2.80 | −34.02 | −14.23 | −59.04 | −11.92 | −53.04 |
| D-1135 | 10.36 | −7.69 | −15.39 | −4.17 | 24.96 | −24.64 | 3.57 | −5.25 |
| D-1147 | 20.97 | −3.11 | 4.36 | 1.69 | 11.90 | 5.13 | 13.93 | 4.34 |
| D-1151 | −4.71 | −14.13 | −15.57 | −17.87 | −12.91 | −34.11 | −1.19 | −14.79 |
| D-1158 | 26.52 | −10.17 | 23.24 | 8.03 | 28.20 | −6.52 | 18.06 | −2.88 |
| D-1162 | −40.01 | −55.60 | −22.04 | −36.60 | −35.29 | −52.50 | −14.02 | −41.72 |
| D-1165 | −3.62 | −54.73 | −7.63 | −23.22 | −0.86 | −51.86 | 15.67 | −18.51 |
| D-1166 | −3.32 | −41.79 | −11.34 | −13.26 | −0.25 | −14.66 | −4.12 | −15.13 |
| D-1167 | −53.20 | −59.29 | −6.34 | −16.20 | −34.68 | −52.65 | 2.38 | −24.06 |
| D-1168 | −31.18 | −46.37 | −1.51 | −9.31 | −4.10 | −34.17 | −15.22 | −20.42 |
| D-1170 | −12.35 | −53.90 | −3.32 | −42.65 | −23.85 | −56.63 | 5.59 | −32.93 |
| D-1171 | 3.82 | −31.95 | −14.62 | −23.16 | −12.00 | −49.39 | 9.90 | −28.40 |
| D-1172 | −45.07 | −58.26 | −1.94 | 3.83 | −40.15 | −56.40 | −18.42 | −45.04 |
| D-1173 | −25.53 | −57.81 | 5.39 | −8.67 | −12.00 | −58.53 | −24.75 | −56.05 |
| D-1174 | 11.06 | −32.05 | 3.06 | −15.60 | −18.38 | −54.41 | −13.38 | −40.99 |
| D-1175 | −35.25 | −47.56 | −9.96 | −1.38 | −31.75 | −44.76 | −24.47 | −34.12 |
| D-1176 | −21.07 | −48.99 | −12.46 | −22.28 | −55.65 | −30.89 | −4.67 | −34.03 |
| D-1206 | −20.58 | −58.56 | −5.65 | −42.60 | −4.41 | −58.69 | 13.47 | −45.33 |
| D-1234 | 0.74 | −45.36 | 6.51 | 4.14 | 13.42 | −37.24 | −0.46 | −19.91 |
| D-1235 | −11.85 | −55.44 | −20.74 | −53.47 | −36.41 | −59.01 | 20.26 | −54.37 |
| D-1237 | −20.08 | −20.98 | 5.99 | 19.18 | 4.30 | −22.26 | 0.55 | 4.37 |
| D-1246 | 18.79 | −44.97 | −0.22 | −40.27 | −18.38 | −57.87 | 7.97 | −44.91 |
| D-1250 | −6.10 | −51.90 | 0.82 | 2.19 | 0.15 | −58.42 | 10.08 | −49.16 |
| D-1257 | −10.36 | −55.00 | 5.39 | 16.17 | −20.30 | −53.64 | −15.58 | −41.86 |
| D-1285 | −15.32 | −50.05 | 8.93 | 9.74 | −18.08 | −56.70 | −12.37 | −45.36 |

TABLE 2-continued

In vitro efficacy of Tier 1 ASGRI siRNA molecules in immunoassay screen

| | Run 1 | | | | Run 2 | | | |
|---|---|---|---|---|---|---|---|---|
| Duplex No. | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-1286 | −30.00 | −55.94 | −0.69 | −28.77 | −11.19 | −48.78 | −2.70 | −42.37 |
| D-1288 | −26.13 | −60.85 | 3.32 | −3.82 | −9.16 | −56.60 | 8.07 | −36.50 |
| D-1289 | −11.95 | −48.94 | −13.41 | 9.24 | −3.49 | −53.30 | −9.72 | −31.07 |
| D-1291 | −21.57 | −62.92 | −2.37 | 4.10 | 10.28 | −57.93 | −5.22 | −46.85 |
| D-1293 | 7.88 | −59.68 | −4.18 | −17.53 | −1.47 | −60.64 | 1.56 | −48.52 |
| D-1294 | −13.93 | −61.42 | 9.01 | −8.13 | 4.20 | −58.50 | 7.79 | −49.89 |
| D-1296 | 32.37 | −35.87 | −3.58 | −26.73 | 21.72 | −42.10 | 28.96 | −8.80 |
| D-1299 | 9.97 | −15.14 | 5.99 | −4.68 | 14.33 | −12.03 | −4.77 | −16.17 |
| D-1301 | 42.98 | 8.71 | 10.05 | 11.59 | 18.48 | −7.91 | 1.65 | 0.99 |
| D-1302 | 8.78 | −15.98 | 11.08 | 4.83 | 4.61 | −11.01 | −0.73 | −2.26 |
| D-1303 | 18.39 | 8.99 | 15.05 | 3.34 | 34.38 | 16.39 | 4.95 | 0.93 |
| D-1335 | −4.41 | −57.42 | −7.81 | −12.59 | −2.78 | −53.97 | −5.32 | −38.92 |
| D-1340 | 15.42 | −56.65 | 12.63 | −47.35 | 18.08 | −56.73 | 11.55 | −47.26 |
| D-1342 | −1.34 | −55.68 | 1.60 | −30.81 | −14.13 | −55.74 | 24.66 | −34.02 |
| D-1350 | 12.25 | −46.29 | 16.43 | −17.81 | 8.86 | −45.60 | 11.73 | −15.78 |
| D-1364 | −36.14 | −58.31 | −7.81 | −45.74 | −31.95 | −57.24 | −2.47 | −42.87 |
| D-1365 | −45.46 | −59.21 | 1.08 | −39.04 | −54.43 | −55.49 | −9.26 | −47.65 |
| D-1367 | −2.23 | −49.60 | 27.47 | −0.24 | 0.35 | −55.94 | 15.49 | −40.01 |
| D-1373 | 29.80 | −55.97 | 22.64 | −34.90 | −9.37 | −57.64 | 15.40 | −50.30 |
| D-1376 | 9.37 | −54.03 | 4.61 | −6.55 | −18.48 | −58.89 | 23.74 | −40.26 |
| D-1387 | −15.62 | −60.74 | 12.03 | −24.43 | −22.84 | −59.13 | −0.46 | −55.15 |
| D-1389 | 37.33 | −60.30 | −1.68 | −58.97 | −6.03 | −59.85 | 6.51 | −56.49 |
| D-1390 | −7.09 | −62.69 | 1.94 | −19.96 | 18.08 | −60.28 | 11.92 | −58.45 |
| D-1397 | −17.90 | −62.94 | 10.13 | −56.73 | 25.06 | −60.77 | 4.12 | −56.43 |
| D-1398 | −7.09 | −61.91 | 9.27 | −39.40 | −6.43 | −56.41 | 27.77 | −34.30 |
| D-1399 | −33.81 | −62.45 | 12.59 | −17.06 | 2.08 | −59.75 | 11.14 | −50.83 |
| D-1400 | 46.65 | −59.41 | 13.50 | −36.58 | 16.15 | −59.11 | 11.92 | −48.21 |
| D-1403 | 24.74 | −0.88 | 20.40 | 4.38 | −19.29 | −29.75 | 11.27 | 4.71 |
| D-1405 | −7.78 | −10.82 | 8.24 | −5.29 | 4.30 | −1.20 | −4.03 | −5.98 |
| D-1406 | −3.92 | −9.59 | −1.85 | −8.89 | −5.01 | −9.40 | 23.74 | 15.19 |
| D-1407 | 18.69 | −3.89 | −7.29 | −12.59 | 4.30 | −19.11 | 9.90 | −6.78 |
| D-1408 | 8.73 | −49.20 | −12.98 | −42.77 | −1.47 | −53.33 | 12.19 | −35.80 |
| D-1426 | −6.79 | −61.40 | −12.46 | −51.50 | −4.30 | −59.00 | −19.34 | −56.51 |
| D-1431 | 5.30 | −58.85 | −8.50 | −53.37 | −3.19 | −57.76 | 0.18 | −47.13 |
| D-1432 | −16.11 | −61.98 | −2.72 | −45.35 | −22.53 | −58.60 | 3.76 | −47.92 |
| D-1438 | 7.09 | −61.80 | 23.59 | −55.97 | 3.49 | −58.39 | 21.45 | −54.63 |
| D-1443 | −10.76 | −62.32 | 2.98 | −59.31 | 3.80 | −59.01 | 8.98 | −54.86 |
| D-1452 | −0.79 | −56.32 | 14.27 | −45.83 | −31.70 | −56.68 | 10.91 | −52.19 |
| D-1453 | 12.05 | −56.42 | 31.87 | −26.99 | −32.86 | −57.12 | 13.47 | −56.95 |
| D-1454 | −25.83 | −60.61 | 2.63 | −24.99 | −23.95 | −59.91 | 9.62 | −55.41 |
| D-1455 | 19.58 | −55.42 | −6.34 | −27.92 | 8.46 | −58.89 | 0.27 | −51.97 |
| D-1472 | 29.80 | −55.21 | −2.89 | −22.04 | −13.42 | −58.75 | 21.91 | −52.79 |
| D-1478 | −3.12 | −60.56 | 7.03 | −3.28 | 4.81 | −58.19 | 12.01 | −43.07 |
| D-1479 | 20.38 | −59.07 | −15.14 | −22.23 | −7.95 | −58.41 | 10.08 | −42.61 |
| D-1484 | −6.30 | −62.62 | 9.87 | −39.24 | 13.01 | −58.78 | 3.76 | −51.54 |
| D-1494 | −13.73 | −63.95 | 6.34 | −41.07 | −11.19 | −60.62 | 22.64 | −59.92 |
| D-1495 | 8.28 | −62.15 | 4.70 | −27.22 | 18.89 | −60.38 | 20.16 | −55.68 |
| D-1497 | 26.13 | −59.97 | 4.96 | −58.89 | 0.05 | −60.05 | 14.12 | −58.30 |
| D-1502 | 14.97 | −45.58 | 1.94 | −38.33 | −4.76 | −54.72 | 5.77 | −38.10 |
| D-1505 | −8.28 | −59.54 | −12.25 | −17.83 | −14.08 | −59.50 | 3.02 | −36.43 |
| D-1506 | 8.18 | −57.99 | 20.91 | −9.71 | −2.48 | −58.59 | 2.11 | −41.88 |
| D-1511 | −0.74 | −15.67 | −2.63 | −10.15 | 1.16 | −14.97 | 13.84 | −0.23 |
| D-1516 | 12.05 | −4.94 | −1.08 | 0.63 | 4.51 | 1.35 | −1.19 | −17.05 |
| D-1518 | −4.21 | −26.51 | −13.58 | −8.51 | −4.00 | −3.46 | 13.57 | −3.88 |
| D-1521 | 18.29 | −23.36 | 6.68 | 1.40 | 20.81 | 15.51 | −3.85 | −13.25 |
| D-1536 | 16.31 | −15.47 | 1.25 | 5.23 | 27.70 | −11.54 | 6.14 | 0.40 |
| D-1554 | 13.24 | −13.40 | −4.70 | 0.95 | 6.63 | −32.03 | 3.30 | −0.92 |
| D-1556 | −26.52 | −41.44 | 3.49 | 6.92 | −3.19 | −13.71 | −1.47 | −10.81 |
| D-1572 | 26.62 | −24.09 | 20.31 | 5.52 | 5.62 | −1.00 | 24.01 | 11.58 |
| D-1578 | −4.71 | −44.74 | −12.89 | −14.92 | 2.78 | −23.50 | 5.22 | −5.92 |
| D-1581 | −23.05 | −27.51 | −16.17 | −14.43 | −22.53 | −12.89 | −2.38 | −15.63 |
| D-1623 | −22.46 | −30.62 | −11.69 | −6.55 | −25.27 | −32.19 | 13.47 | 4.71 |
| D-1627 | 12.25 | −23.19 | −4.96 | −29.97 | −10.89 | −38.16 | 1.56 | −25.15 |
| D-1653 | 11.06 | −32.19 | 9.44 | 0.09 | −4.71 | −32.15 | 19.52 | 0.81 |
| D-1656 | 5.60 | −38.39 | 1.51 | −22.78 | −21.42 | −49.42 | 3.94 | −21.36 |
| D-1678 | −32.77 | −50.41 | −16.52 | −23.47 | −15.04 | −44.98 | 5.50 | −6.64 |
| D-1683 | 11.65 | −32.74 | 4.53 | −1.23 | 4.81 | −26.86 | 13.75 | −6.80 |
| D-1686 | 2.63 | −31.87 | −13.15 | −4.49 | 13.42 | −13.30 | 23.37 | −3.19 |
| D-1687 | −1.54 | −38.12 | −0.56 | −8.62 | −17.37 | −40.05 | 21.08 | −7.89 |
| D-1694 | −15.82 | −54.86 | 8.58 | −24.98 | −29.82 | −48.50 | 14.02 | −28.37 |

TABLE 2-continued

In vitro efficacy of Tier 1 ASGRI siRNA molecules in immunoassay screen

| Duplex No. | Run 1 Cell count 5 nM | Run 1 Normalized Alexa 488 Mean Intensity 5 nM | Run 1 Cell count 1.25 nM | Run 1 Normalized Alexa 488 Mean Intensity 1.25 nM | Run 2 Cell count 5 nM | Run 2 Normalized Alexa 488 Mean Intensity 5 nM | Run 2 Cell count 1.25 nM | Run 2 Normalized Alexa 488 Mean Intensity 1.25 nM |
|---|---|---|---|---|---|---|---|---|
| D-1708 | −17.80 | −55.25 | −2.03 | −31.77 | −34.99 | −52.79 | 9.62 | −30.91 |
| D-1709 | −8.28 | −48.76 | 10.65 | −2.99 | 9.06 | −33.13 | 33.36 | −2.17 |
| D-1713 | −6.40 | −19.58 | −18.76 | 10.36 | −7.85 | −17.32 | 10.91 | 10.44 |
| D-1716 | 14.03 | −45.60 | 22.38 | −5.99 | 18.78 | −49.38 | 8.71 | −45.19 |
| D-1719 | −17.50 | −53.30 | 8.75 | 6.89 | −29.92 | −56.30 | 17.69 | −20.17 |
| D-1722 | 22.06 | −49.25 | 6.94 | −6.97 | 2.99 | −53.32 | 16.96 | −42.54 |
| D-1734 | 27.32 | −44.60 | 14.19 | 0.24 | −7.04 | −56.49 | 1.10 | −44.07 |
| D-1741 | −2.63 | −45.97 | 2.80 | −2.87 | −32.15 | −55.22 | 16.68 | −18.26 |
| D-1748 | 7.09 | −50.05 | 11.51 | −16.11 | −34.28 | −57.38 | 8.98 | −36.62 |
| D-1750 | 39.91 | −43.78 | 12.81 | 15.45 | 30.63 | −43.98 | 24.38 | −12.48 |
| D-1752 | 1.54 | −56.17 | −3.23 | −14.35 | 15.54 | −53.71 | 10.91 | −34.83 |
| D-1773 | −11.25 | −61.04 | 7.72 | −10.35 | −19.80 | −58.31 | 20.53 | −50.30 |
| D-1777 | −11.16 | −53.95 | −1.51 | −27.84 | −0.05 | −50.07 | 14.57 | −28.05 |
| D-1792 | 4.51 | −10.06 | 7.98 | 2.31 | 31.44 | −0.79 | 15.67 | −0.52 |
| D-1798 | −29.00 | −58.63 | 6.17 | −49.28 | −32.05 | −58.49 | 8.71 | −54.61 |
| D-1801 | 19.58 | −52.66 | −11.00 | −46.00 | −13.62 | −58.81 | 12.65 | −45.62 |
| D-1807 | 14.33 | −36.45 | −3.41 | −8.24 | 1.57 | −47.37 | 6.87 | −33.08 |
| D-1808 | 21.77 | −50.54 | 5.48 | −1.08 | −25.16 | −58.30 | 14.12 | −44.68 |
| D-1811 | 26.92 | −48.75 | −9.27 | −37.36 | 10.89 | −59.48 | −2.38 | −43.87 |
| D-1813 | 15.82 | −59.88 | 5.30 | −5.72 | 48.86 | −55.18 | 12.83 | −51.46 |
| D-1814 | 9.47 | −11.40 | −4.10 | 5.65 | −6.53 | −25.64 | 6.97 | 6.28 |
| D-1815 | 20.18 | −57.38 | 0.39 | −46.20 | 3.80 | −59.35 | 8.07 | −49.05 |
| D-1819 | −14.33 | −53.70 | −4.53 | −25.39 | −21.62 | −29.60 | −2.02 | −34.84 |
| D-1824 | 8.58 | −61.67 | 2.03 | −52.48 | −1.97 | −60.35 | 0.73 | −48.34 |
| D-1826 | −1.14 | −59.23 | 3.75 | −55.52 | −1.47 | −59.41 | 0.82 | −56.95 |
| D-1832 | 22.06 | −57.11 | −7.63 | −32.20 | −8.25 | −59.70 | −12.01 | −58.04 |
| D-1840 | 18.89 | −48.93 | 12.29 | −24.02 | −14.33 | −57.91 | 8.52 | −41.61 |
| D-1842 | 8.18 | −57.58 | −2.63 | −11.59 | −22.63 | −59.42 | 9.99 | −52.24 |
| D-1848 | 3.12 | 1.44 | −12.81 | −3.07 | −24.35 | −34.25 | −14.57 | −5.02 |
| D-1874 | −1.14 | −8.57 | −3.88 | 1.72 | −24.25 | 0.91 | −13.79 | −3.21 |
| D-1876 | 12.10 | −54.54 | −0.78 | −5.14 | 17.01 | −53.11 | 5.18 | −29.31 |
| D-1929 | 4.51 | −53.02 | −8.50 | −37.65 | −9.97 | −56.26 | 15.86 | −35.66 |
| D-1975 | −1.83 | −60.71 | −8.06 | −22.41 | 24.86 | −59.22 | 6.05 | −45.07 |
| D-1981 | 4.81 | −59.13 | −3.67 | −21.74 | 19.29 | −57.31 | 12.56 | −49.72 |
| D-1983 | 25.63 | −60.82 | −6.94 | −53.04 | 18.28 | −59.21 | 13.38 | −50.18 |
| D-1987 | −0.25 | −51.50 | −17.12 | −5.68 | −7.34 | −56.91 | −0.37 | −49.23 |
| D-1989 | 25.93 | −59.04 | −0.22 | −56.06 | 19.70 | −59.14 | −0.37 | −57.37 |
| D-1994 | −30.59 | −40.01 | 16.08 | −2.53 | −26.18 | −40.53 | −20.81 | −34.18 |
| D-1999 | −5.30 | −59.22 | −0.22 | −28.91 | −3.90 | −54.46 | −11.00 | −58.90 |
| D-2000 | −6.40 | −52.51 | −10.22 | −41.18 | −13.92 | −56.51 | −6.78 | −47.04 |
| D-2006 | 6.10 | −56.48 | −11.00 | −34.67 | −23.75 | −59.18 | −17.14 | −47.29 |
| D-2008 | 1.54 | −54.28 | 3.67 | −27.83 | −17.27 | −59.63 | −12.37 | −44.60 |
| D-2010 | −6.69 | −53.88 | −4.27 | −9.69 | −11.39 | −58.47 | 4.58 | −44.37 |
| D-2021 | −10.96 | −53.49 | −18.84 | −40.95 | −1.27 | −53.90 | 13.38 | −33.91 |
| D-2045 | −26.82 | −58.06 | 4.87 | −22.24 | −22.13 | −56.67 | −14.48 | −39.83 |
| D-2050 | −5.01 | −32.58 | −17.81 | −23.38 | −13.52 | −49.82 | −11.82 | −31.36 |
| D-2054 | 14.33 | −46.36 | −18.50 | −38.37 | −11.90 | −53.12 | 2.20 | −26.56 |
| D-2056 | 6.89 | −56.26 | −21.26 | −48.12 | −5.22 | −60.11 | 0.09 | −45.21 |
| D-2059 | −25.53 | −60.64 | −4.01 | −12.60 | −29.52 | −59.15 | −7.79 | −56.33 |
| D-2064 | −42.29 | −55.85 | −2.37 | −0.05 | −37.01 | −59.20 | 2.57 | −49.72 |
| D-2066 | −27.12 | −62.04 | 0.56 | −21.81 | −19.39 | −58.62 | −9.17 | −56.56 |
| D-2069 | −2.63 | −61.10 | 0.04 | −43.17 | 14.13 | −57.57 | 2.84 | −43.86 |
| D-2081 | −16.66 | −47.70 | −3.41 | −8.40 | 17.62 | −54.09 | 3.16 | −27.64 |
| D-2095 | 4.51 | −59.69 | −7.72 | −31.26 | −3.90 | −56.37 | 13.84 | −27.54 |
| D-2107 | −40.01 | −57.62 | 0.73 | −1.33 | −19.70 | −48.12 | −0.64 | −30.71 |
| D-2115 | −39.12 | −41.56 | −26.35 | −31.43 | −40.86 | −31.71 | −3.21 | −20.71 |
| D-2122 | −42.09 | −54.90 | −19.62 | −36.56 | −37.22 | −56.76 | 0.82 | −33.96 |
| D-2124 | −8.08 | −46.96 | −14.19 | −0.08 | −17.37 | −47.88 | −21.54 | −22.67 |
| D-2130 | −5.40 | −22.16 | 3.41 | 11.97 | −17.57 | −33.56 | −18.52 | −18.45 |
| D-2133 | −25.93 | −46.79 | −19.97 | −5.63 | −36.51 | −50.48 | 8.16 | −10.25 |
| D-2134 | −39.81 | −61.69 | −16.26 | −31.95 | −22.43 | −59.20 | 1.74 | −34.15 |
| D-2136 | −11.80 | −42.20 | −6.34 | −4.68 | −21.87 | −56.73 | 6.32 | −21.07 |
| D-2137 | −30.59 | −61.11 | −10.74 | −24.82 | 5.62 | −49.50 | 17.42 | −17.59 |
| D-2142 | −26.82 | −56.29 | 14.79 | 3.81 | 2.68 | −46.12 | 6.51 | −21.91 |
| D-2143 | −35.25 | −56.55 | −11.08 | −41.09 | −21.32 | −58.35 | 13.84 | −32.12 |
| D-2172 | 7.29 | −29.17 | −1.34 | 12.93 | −6.03 | −34.12 | 13.11 | 11.63 |
| D-2174 | 2.03 | −51.87 | 4.79 | 4.73 | 6.84 | −47.31 | 7.9 | −30.31 |
| D-2192 | 14.43 | −41.72 | 15.48 | −11.07 | 24.96 | −44.47 | 21.91 | −24.19 |
| D-2196 | 1.64 | −52.44 | 14.27 | −0.40 | −34.38 | −55.66 | −0.82 | −47.45 |
| D-2199 | 26.82 | −56.29 | −4.01 | −2.81 | 20.71 | −58.07 | 12.37 | −38.76 |

TABLE 2-continued

In vitro efficacy of Tier 1 ASGRI siRNA molecules in immunoassay screen

| | Run 1 | | | | Run 2 | | | |
|---|---|---|---|---|---|---|---|---|
| Duplex No. | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-2200 | 5.01 | −38.18 | 8.50 | 9.77 | 12.51 | −44.01 | 18.42 | −25.19 |
| D-2202 | 5.85 | −5.08 | −2.24 | 1.89 | −1.47 | 6.11 | 1.37 | −0.43 |
| D-2210 | −20.87 | −58.61 | 2.29 | −24.34 | −1.57 | −44.74 | 15.58 | −23.79 |
| D-2224 | 13.34 | −54.07 | 14.70 | −17.77 | 39.54 | −51.64 | 2.57 | −36.75 |
| D-2230 | −23.95 | −40.70 | −2.54 | −5.35 | −10.68 | −6.76 | 20.26 | 15.29 |
| D-2236 | 9.17 | −55.50 | −4.44 | −35.30 | 4.51 | −46.56 | −3.57 | −27.54 |
| D-2238 | 16.01 | −48.75 | −9.79 | −29.17 | 21.42 | −42.21 | 6.14 | −28.27 |
| D-2266 | 8.08 | −14.56 | 3.84 | −18.65 | 6.73 | −28.22 | 6.51 | −12.90 |
| D-2267 | 9.27 | 0.67 | −1.60 | 3.64 | −41.87 | −43.95 | 14.85 | 15.50 |
| D-2294 | 25.63 | −7.76 | 14.01 | 6.68 | −8.66 | −31.02 | 17.78 | 4.99 |
| D-2296 | 16.81 | −28.11 | −1.94 | −17.85 | −13.22 | −41.06 | 17.32 | −11.82 |
| D-2300 | −26.13 | −57.30 | 8.32 | 0.46 | −45.22 | −53.30 | 3.94 | −29.90 |
| D-2301 | −15.72 | −38.46 | 22.38 | 5.62 | −9.87 | −38.50 | −9.07 | −20.00 |
| D-2304 | 14.53 | −53.06 | 4.79 | −16.86 | −20.91 | −58.98 | 15.03 | −42.20 |
| D-2311 | −60.73 | −63.05 | 1.25 | −54.94 | −59.90 | −59.83 | 6.78 | −51.22 |
| D-2322 | 9.07 | −53.47 | −1.60 | −28.61 | −3.70 | −53.94 | 5.32 | −34.29 |
| D-2335 | 2.73 | −59.25 | 7.46 | −44.73 | −3.09 | −57.83 | 2.02 | −37.63 |
| D-2354 | 3.12 | −52.45 | 16.77 | 7.77 | 7.04 | −49.64 | 15.31 | −39.67 |
| D-2357 | 46.55 | −51.86 | 14.45 | −45.90 | 3.39 | −59.31 | 3.85 | −56.37 |
| D-2360 | 22.46 | −57.37 | 24.71 | −13.55 | 19.49 | −56.45 | 19.80 | −34.93 |
| D-2361 | 11.16 | −50.62 | 10.31 | −17.97 | 42.58 | −57.92 | 12.37 | −49.42 |
| D-2362 | 24.54 | −24.39 | 5.22 | 3.25 | 10.08 | −36.37 | 17.14 | −0.36 |
| D-2374 | 32.97 | −24.51 | −9.10 | 1.81 | 13.01 | −36.58 | 9.07 | −25.51 |
| D-2388 | −18.59 | −43.66 | 12.38 | 0.51 | −10.58 | −29.34 | 30.98 | 10.51 |
| D-2399 | −39.22 | −56.10 | −4.18 | −28.95 | −68.10 | −59.66 | −39.60 | −51.94 |
| D-2401 | −30.49 | −59.59 | −1.25 | −11.64 | −40.30 | −57.59 | 10.04 | −34.66 |
| D-2403 | −8.97 | −61.28 | 2.20 | −9.13 | −14.63 | −57.17 | 38.59 | −13.48 |
| D-2412 | 15.62 | 6.15 | 12.89 | 11.91 | 2.18 | −12.33 | 12.10 | −4.72 |
| D-2461 | −19.78 | −56.95 | −6.34 | −54.93 | −35.49 | −57.76 | −7.52 | −49.34 |
| D-2462 | 18.79 | −21.80 | 11.25 | −2.95 | −32.35 | −52.99 | −2.84 | −24.30 |
| D-2465 | 13.83 | −55.08 | 7.89 | −7.64 | 1.97 | −58.56 | 20.90 | −43.55 |
| D-2466 | 28.90 | −49.02 | −7.29 | −8.54 | −17.47 | −57.63 | 17.05 | −43.13 |
| D-2468 | 9.17 | −52.16 | −5.74 | −14.25 | 43.70 | −57.19 | 12.47 | −48.60 |
| D-2475 | −28.90 | −54.23 | −7.12 | −5.24 | −47.75 | −56.37 | 5.04 | −38.94 |
| D-2481 | 12.94 | −55.66 | 3.23 | −12.64 | 3.70 | −54.71 | 18.42 | −28.59 |
| D-2487 | 17.50 | −10.84 | −4.01 | −0.05 | 9.37 | −7.38 | 14.12 | 1.83 |

Of the 211 unmodified siRNA molecules screened in Tier 1, at the 5 nM concentration, about 168 siRNA molecules reduced ASGR1 cell surface expression relative to control cells by at least 30%, about 119 siRNA molecules reduced ASGR1 cell surface expression relative to control cells by at least 50%, and about 30 siRNA molecules reduced ASGR1 cell surface expression relative to control cells by at least 60%. Some of the siRNA molecules exhibited no or marginal reduction in ASGR1 cell surface expression relative to control cells.

A subset of the siRNA molecules from this initial screen of the Tier 1 molecules were selected for further testing in a 10-point dose response format (0.004 nM to 83 nM) in the in vitro anti-ASGR1 immunoassay in Hep3B cells. IC50 values for each of these 55 siRNA molecules were calculated from the dose-response curves and are shown in Table 3 below. Data from two independent transfections of each siRNA molecule (Run 1 and Run 2) are shown. At least 18 of the siRNA molecules had IC50 values of about 0.30 nM or less. Compounds D-1983, D-1098, D-1438, D-1246, and D-1494 were among the most potent with average IC50 values less than 0.15 nM.

TABLE 3

IC50 values determined by immunoassay for select ASGRI siRNA molecules

| Duplex No. | Run 1 IC50 (nM) | Run 2 IC50 (nM) |
|---|---|---|
| D-1055 | >83.33 | >83.33 |
| D-1082 | 0.72 | 1.10 |
| D-1089 | 0.15 | 0.24 |
| D-1098 | 0.08 | 0.09 |
| D-1168 | 1.98 | 1.74 |
| D-1170 | 0.32 | 0.20 |
| D-1171 | 1.01 | 0.56 |
| D-1173 | 0.64 | 0.23 |
| D-1176 | 1.48 | 0.95 |
| D-1206 | 0.74 | 0.25 |
| D-1235 | 0.58 | 0.35 |
| D-1246 | 0.17 | 0.11 |
| D-1340 | 0.31 | 0.44 |
| D-1364 | 0.51 | 0.72 |
| D-1373 | 0.22 | 0.32 |
| D-1389 | 0.19 | 0.12 |
| D-1397 | 0.47 | 0.08 |
| D-1408 | 0.90 | 0.44 |
| D-1426 | 0.26 | 0.43 |
| D-1431 | 0.41 | 0.54 |
| D-1432 | 3.39 | 3.31 |
| D-1438 | 0.10 | 0.16 |

TABLE 3-continued

IC50 values determined by immunoassay for select ASGRI siRNA molecules

| Duplex No. | Run 1 IC50 (nM) | Run 2 IC50 (nM) |
|---|---|---|
| D-1443 | 0.53 | 0.28 |
| D-1472 | 0.57 | 0.60 |
| D-1484 | 0.29 | 0.17 |
| D-1494 | 0.21 | 0.07 |
| D-1497 | 1.50 | 0.15 |
| D-1686 | 27.78 | >83.33 |
| D-1708 | 0.66 | 0.56 |
| D-1798 | 0.48 | 0.52 |
| D-1801 | 0.50 | 0.76 |
| D-1811 | 0.73 | 0.57 |
| D-1813 | 0.29 | 0.29 |
| D-1815 | 0.80 | 0.24 |
| D-1824 | 0.39 | 0.33 |
| D-1826 | 1.08 | 0.07 |
| D-1832 | 0.26 | 0.12 |
| D-1981 | 1.33 | 0.46 |
| D-1983 | 0.05 | 0.05 |
| D-1989 | 1.35 | 0.83 |
| D-1999 | 0.23 | 0.14 |
| D-2000 | 0.67 | 0.45 |
| D-2006 | 0.52 | 0.55 |
| D-2045 | 0.14 | 0.21 |
| D-2056 | 0.27 | 0.19 |
| D-2069 | 1.33 | 1.33 |
| D-2122 | 0.80 | 1.41 |
| D-2142 | 2.07 | 1.12 |
| D-2143 | 1.12 | 0.68 |
| D-2311 | 0.56 | 0.46 |
| D-2335 | 0.28 | 0.23 |
| D-2357 | 0.38 | 0.28 |
| D-2361 | 0.75 | 0.70 |
| D-2401 | 0.99 | 0.76 |
| D-2461 | 1.05 | 0.91 |

All of the Tier 2 siRNA molecules, except for 8 siRNA molecules targeting the 5' and 3' ends of the human ASGR1 transcript, were tested in the in vitro anti-ASGR1 immunoassay in Hep3B cells at two different concentrations (1.25 nM and 5 nM). The reduction in ASGR1 cell surface expression relative to expression in cells transfected with non-targeting siRNAs in Hep3B cells for each siRNA molecule is shown in Table 4 below. Cell count measurements are also provided.

TABLE 4

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1000 | −7.89 | −69.66 | 14.36 | −16.59 |
| D-1001 | −37.89 | −69.18 | 2.85 | −24.50 |
| D-1002 | −31.79 | −57.03 | 11.54 | −1.83 |
| D-1003 | −3.36 | 37.23 | 9.55 | −2.29 |
| D-1004 | 1.60 | −59.64 | 8.80 | −8.51 |
| D-1005 | 3.05 | −28.72 | −1.24 | 2.39 |
| D-1006 | −32.96 | −57.28 | −7.05 | −9.66 |
| D-1007 | −27.69 | −70.79 | 14.31 | −3.33 |
| D-1008 | 30.65 | 9.28 | 20.79 | 12.22 |
| D-1009 | −23.35 | −73.69 | 11.67 | −2.29 |
| D-1010 | 35.43 | −55.89 | 3.56 | −22.96 |
| D-1012 | 16.98 | −75.78 | 10.37 | −34.40 |
| D-1013 | 24.10 | 12.20 | 8.33 | 2.11 |
| D-1014 | 7.31 | −65.21 | 12.97 | −6.17 |
| D-1015 | −7.71 | −73.25 | 16.15 | −4.04 |
| D-1016 | −60.21 | −61.66 | 6.81 | 14.15 |
| D-1017 | 11.83 | −56.24 | 4.70 | 2.01 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1019 | 29.84 | −64.73 | −1.46 | −12.82 |
| D-1020 | 25.65 | −53.00 | −2.67 | −10.04 |
| D-1021 | −26.83 | −75.10 | 2.11 | −12.78 |
| D-1022 | −0.55 | −59.91 | −3.68 | −22.68 |
| D-1023 | −0.29 | 13.64 | 11.80 | 2.03 |
| D-1025 | 27.98 | −1.15 | 7.76 | −2.93 |
| D-1026 | −18.53 | −56.89 | 13.22 | 8.74 |
| D-1027 | 55.59 | −36.50 | 11.10 | 1.38 |
| D-1028 | −32.96 | −19.81 | 5.19 | −0.71 |
| D-1029 | −20.89 | −63.26 | 13.44 | −5.46 |
| D-1030 | 27.16 | −43.18 | 5.36 | −9.83 |
| D-1031 | 6.49 | −13.65 | 23.42 | 2.27 |
| D-1032 | −1.16 | −10.97 | −4.20 | −13.77 |
| D-1033 | −30.24 | −69.98 | −0.58 | −13.92 |
| D-1034 | −28.53 | −23.08 | 9.46 | 3.34 |
| D-1035 | 25.32 | −65.71 | 3.16 | −16.06 |
| D-1037 | −3.94 | −52.11 | 11.55 | −9.25 |
| D-1038 | −7.40 | −57.60 | 16.02 | −6.46 |
| D-1039 | 14.47 | −71.31 | 9.64 | −34.96 |
| D-1040 | −4.57 | −54.21 | 14.10 | −0.10 |
| D-1041 | −11.52 | −69.09 | −6.14 | −14.98 |
| D-1042 | −30.28 | −38.43 | −4.52 | −15.31 |
| D-1043 | 36.88 | −29.24 | 6.55 | −7.92 |
| D-1044 | 2.11 | 33.99 | 18.08 | 14.48 |
| D-1045 | −51.56 | −57.05 | 6.11 | −6.29 |
| D-1046 | −4.10 | −54.90 | 18.23 | 4.76 |
| D-1047 | 2.37 | −61.85 | 10.29 | 5.28 |
| D-1048 | 47.43 | −78.54 | 22.26 | −40.26 |
| D-1049 | −21.19 | −48.21 | 18.33 | 3.60 |
| D-1050 | −48.89 | −66.58 | 2.19 | −5.94 |
| D-1051 | −24.11 | −78.56 | 9.89 | −3.84 |
| D-1052 | 20.98 | −65.51 | −1.22 | −10.60 |
| D-1053 | −24.22 | −33.53 | 16.74 | 0.96 |
| D-1054 | 13.12 | −66.55 | −6.19 | −20.07 |
| D-1055 | −1.47 | −30.04 | 5.24 | −6.10 |
| D-1056 | −5.32 | −74.11 | 21.67 | −19.44 |
| D-1057 | −4.16 | 8.07 | −2.83 | −19.78 |
| D-1058 | 15.98 | −60.00 | 9.56 | −6.36 |
| D-1059 | 48.61 | −77.08 | 1.54 | −3.17 |
| D-1060 | −15.59 | −38.07 | 4.82 | 2.38 |
| D-1061 | −23.58 | 28.91 | 13.89 | −4.03 |
| D-1062 | 6.14 | −17.75 | 38.76 | 11.62 |
| D-1064 | 0.34 | −47.84 | 4.56 | −9.18 |
| D-1065 | 6.79 | −66.80 | 6.78 | −22.67 |
| D-1066 | −65.89 | −80.55 | 2.45 | −7.49 |
| D-1067 | −33.03 | −50.01 | −10.13 | −11.57 |
| D-1068 | 24.92 | 34.77 | 12.70 | −11.13 |
| D-1070 | −2.32 | −77.56 | 4.69 | −41.44 |
| D-1071 | −13.75 | −49.58 | −4.45 | −27.30 |
| D-1072 | −17.16 | −71.02 | 5.27 | −11.02 |
| D-1073 | 3.53 | −70.15 | 0.08 | −20.71 |
| D-1074 | −2.69 | −52.58 | −3.32 | −13.23 |
| D-1075 | −29.75 | −69.26 | 1.62 | 1.87 |
| D-1076 | −19.38 | −47.86 | −12.97 | −23.12 |
| D-1077 | 9.29 | −65.14 | 9.30 | −6.34 |
| D-1078 | −23.33 | −40.07 | 5.01 | −3.70 |
| D-1079 | −42.01 | −63.78 | 0.89 | 0.06 |
| D-1080 | −17.33 | −44.28 | 2.34 | 2.62 |
| D-1081 | 13.97 | −12.08 | 12.60 | 0.04 |
| D-1082 | 31.36 | −61.76 | −6.47 | −45.11 |
| D-1083 | −4.22 | −78.92 | 24.94 | −13.91 |
| D-1084 | 0.24 | −78.23 | 0.59 | −7.50 |
| D-1085 | −11.36 | −44.47 | 0.49 | −16.32 |
| D-1086 | −7.98 | −30.62 | 16.32 | 1.09 |
| D-1087 | −4.69 | −48.31 | 14.94 | −7.65 |
| D-1088 | 34.69 | −75.14 | 3.15 | −32.99 |
| D-1089 | −0.64 | 14.68 | 10.29 | 0.81 |
| D-1090 | 24.33 | −73.19 | 1.58 | −29.18 |
| D-1092 | 15.32 | −38.05 | 22.85 | 7.63 |
| D-1093 | 16.98 | −66.40 | 5.15 | −3.92 |
| D-1094 | −28.11 | −76.79 | 9.05 | −12.11 |
| D-1095 | −62.01 | −80.60 | −6.17 | −18.12 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1096 | 29.08 | −59.93 | 22.01 | −14.91 |
| D-1097 | −3.49 | −57.96 | 13.47 | −9.93 |
| D-1098 | −4.13 | −77.54 | 18.58 | 11.13 |
| D-1099 | 1.50 | −37.43 | 13.86 | −9.51 |
| D-1100 | 36.33 | −34.40 | −4.77 | −12.29 |
| D-1101 | 18.17 | −67.20 | −3.35 | −12.05 |
| D-1102 | −32.57 | −36.16 | 7.11 | −2.90 |
| D-1103 | 14.19 | −66.58 | 2.19 | −4.37 |
| D-1104 | −26.08 | −71.40 | −0.66 | −21.29 |
| D-1105 | 26.73 | −18.96 | 3.08 | −10.81 |
| D-1106 | 4.76 | −60.72 | 7.37 | 6.57 |
| D-1107 | 0.97 | −31.43 | 9.38 | −3.31 |
| D-1108 | −8.06 | −74.96 | 3.16 | −35.88 |
| D-1109 | 16.36 | −42.30 | 4.53 | −4.72 |
| D-1110 | 12.49 | −25.10 | 24.01 | 5.26 |
| D-1111 | 30.30 | −7.13 | 2.99 | −8.86 |
| D-1112 | −13.01 | −16.74 | 27.80 | 11.70 |
| D-1113 | 6.34 | −59.24 | 10.21 | −0.62 |
| D-1114 | −24.13 | −24.51 | 9.04 | −7.34 |
| D-1115 | −24.09 | −75.18 | −10.45 | −43.54 |
| D-1116 | −15.10 | −30.34 | 12.21 | −0.66 |
| D-1117 | 17.76 | 9.45 | 4.90 | 8.17 |
| D-1118 | 2.98 | −22.01 | 21.22 | 1.82 |
| D-1119 | −14.42 | −29.69 | −4.61 | −9.83 |
| D-1120 | −8.07 | −59.22 | 2.09 | −18.67 |
| D-1121 | 1.37 | −38.92 | 0.00 | −18.03 |
| D-1122 | −25.60 | −13.63 | −16.07 | −5.83 |
| D-1123 | −23.76 | −13.41 | 18.49 | −0.36 |
| D-1124 | 29.36 | −39.05 | 30.71 | 8.55 |
| D-1125 | 15.34 | −60.37 | −1.83 | −18.69 |
| D-1126 | 8.35 | −20.20 | 11.35 | 14.70 |
| D-1127 | 13.94 | −56.41 | 4.37 | −23.47 |
| D-1128 | −9.29 | −43.79 | 11.18 | 7.39 |
| D-1129 | −36.45 | −70.33 | 7.05 | 19.91 |
| D-1130 | 7.87 | −58.39 | −6.32 | −12.47 |
| D-1131 | −4.69 | −60.73 | 11.29 | −12.42 |
| D-1132 | 13.53 | 3.34 | 20.18 | 10.44 |
| D-1133 | 6.11 | −32.84 | 10.06 | −9.99 |
| D-1134 | −8.48 | −55.96 | 5.75 | −15.23 |
| D-1136 | −23.95 | −25.01 | 15.68 | −0.43 |
| D-1137 | −31.73 | −70.89 | 5.75 | −7.02 |
| D-1138 | 25.27 | 3.96 | 10.59 | −5.05 |
| D-1139 | 36.30 | 16.88 | 9.30 | 0.56 |
| D-1140 | 38.80 | −11.18 | 8.96 | −9.00 |
| D-1141 | −9.08 | −59.67 | 1.92 | −3.78 |
| D-1142 | −2.57 | −29.79 | 4.60 | −9.26 |
| D-1143 | 10.00 | −23.14 | 18.41 | 3.98 |
| D-1144 | −22.41 | −67.81 | 5.16 | −4.68 |
| D-1145 | −11.01 | −39.40 | 14.98 | −5.93 |
| D-1146 | 20.61 | −60.09 | 5.83 | −14.30 |
| D-1148 | −32.46 | −42.55 | 24.90 | 13.98 |
| D-1149 | −9.39 | −20.73 | −4.28 | −13.98 |
| D-1150 | 16.11 | −22.00 | 7.88 | −9.56 |
| D-1152 | −54.17 | −60.99 | 7.05 | −4.58 |
| D-1153 | 11.52 | −30.76 | −12.21 | −20.90 |
| D-1154 | −0.73 | −46.96 | 6.97 | −6.28 |
| D-1155 | 7.26 | −13.95 | 3.23 | −13.24 |
| D-1156 | 3.05 | −46.25 | 13.69 | −5.66 |
| D-1157 | 12.93 | −59.47 | 16.23 | −11.64 |
| D-1159 | −29.47 | −55.55 | 1.70 | −4.00 |
| D-1160 | −0.42 | −73.42 | −0.81 | −10.76 |
| D-1161 | 18.25 | −23.94 | 6.32 | 6.22 |
| D-1163 | −44.43 | −63.99 | 13.02 | −0.59 |
| D-1164 | −7.43 | −49.38 | 8.03 | −6.32 |
| D-1168 | 1.65 | −40.89 | 4.12 | −19.65 |
| D-1169 | −19.55 | −49.51 | 13.74 | −5.68 |
| D-1170 | −26.61 | −71.74 | 7.70 | −2.54 |
| D-1171 | 4.11 | −75.01 | 22.41 | 11.35 |
| D-1173 | 45.33 | −49.69 | 7.69 | −11.52 |
| D-1176 | −14.04 | 39.10 | 14.23 | 10.32 |
| D-1177 | −25.04 | −68.88 | 3.57 | −5.82 |
| D-1178 | 18.05 | −75.84 | 9.63 | −21.29 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1179 | 9.45 | −28.67 | 5.52 | 1.22 |
| D-1180 | −11.55 | 0.73 | −1.94 | −1.98 |
| D-1181 | −30.55 | −78.57 | 15.31 | −17.01 |
| D-1182 | −40.88 | −57.42 | 9.63 | −11.33 |
| D-1183 | 24.63 | −66.53 | 5.98 | −10.91 |
| D-1184 | −13.11 | −33.62 | 8.80 | −6.36 |
| D-1185 | −16.61 | −39.82 | 12.97 | 5.82 |
| D-1186 | 19.94 | −59.27 | 9.32 | −5.26 |
| D-1187 | −0.73 | −68.89 | −3.98 | −15.07 |
| D-1188 | −32.58 | −53.36 | −10.13 | −28.19 |
| D-1189 | −11.28 | −72.46 | 8.12 | −12.36 |
| D-1190 | −13.36 | −51.18 | 6.31 | −13.35 |
| D-1191 | −18.43 | −12.80 | 8.62 | −7.05 |
| D-1192 | 5.78 | −70.90 | 11.63 | −38.66 |
| D-1193 | −12.63 | −39.72 | 13.11 | −2.18 |
| D-1194 | −7.12 | 59.76 | 23.34 | 19.24 |
| D-1195 | −39.18 | −71.13 | 0.73 | −0.80 |
| D-1196 | 19.11 | 3.83 | 20.58 | 7.12 |
| D-1197 | −3.58 | −53.14 | 10.96 | −4.07 |
| D-1198 | 11.37 | −60.62 | 44.32 | 7.61 |
| D-1199 | 2.66 | −40.94 | −10.62 | −20.63 |
| D-1200 | −31.07 | −78.56 | 2.19 | −15.79 |
| D-1201 | −8.03 | −18.56 | 9.05 | 3.62 |
| D-1202 | 6.39 | 19.18 | 11.88 | 10.69 |
| D-1203 | −23.94 | −38.26 | 11.97 | −7.76 |
| D-1204 | 18.53 | −34.62 | 14.06 | −0.10 |
| D-1205 | 51.91 | −39.17 | −3.16 | −17.83 |
| D-1206 | −37.20 | −73.16 | −3.16 | −20.83 |
| D-1207 | −45.60 | −78.35 | 4.10 | −17.84 |
| D-1208 | 17.42 | −61.26 | 3.15 | −27.63 |
| D-1209 | 0.09 | −22.29 | 3.77 | 1.55 |
| D-1210 | −7.52 | −0.01 | 7.11 | −3.27 |
| D-1212 | −25.06 | −80.96 | −10.57 | −28.32 |
| D-1213 | −16.69 | −70.97 | −1.58 | −20.96 |
| D-1214 | 19.94 | −18.87 | −14.23 | −21.87 |
| D-1215 | −3.19 | −64.93 | 12.37 | −10.03 |
| D-1216 | −20.89 | −56.88 | 5.19 | 8.45 |
| D-1217 | −4.76 | −59.77 | −0.32 | 0.60 |
| D-1218 | 8.81 | −1.56 | 1.67 | −13.50 |
| D-1219 | 8.72 | −15.45 | 5.43 | 4.40 |
| D-1220 | −3.92 | −54.00 | 10.62 | −3.14 |
| D-1221 | −9.45 | −78.87 | 25.02 | −19.76 |
| D-1222 | 24.49 | 16.25 | 9.14 | −7.22 |
| D-1223 | −4.11 | −38.73 | 16.18 | 3.39 |
| D-1224 | 5.78 | −63.52 | 11.05 | −0.39 |
| D-1225 | −27.52 | −39.12 | 12.80 | −6.49 |
| D-1226 | 25.32 | −71.53 | 3.43 | −7.69 |
| D-1227 | −2.40 | −60.87 | 22.20 | 3.16 |
| D-1228 | 20.18 | −11.50 | 25.69 | 15.83 |
| D-1229 | −21.59 | −40.96 | 7.68 | −3.08 |
| D-1230 | −6.72 | −60.01 | 8.80 | −12.19 |
| D-1231 | −11.10 | −17.77 | 11.88 | −0.38 |
| D-1232 | −23.04 | −56.57 | 4.37 | −16.21 |
| D-1233 | −46.59 | −69.92 | 4.90 | −24.43 |
| D-1235 | 6.78 | −71.94 | 8.16 | −14.27 |
| D-1236 | −8.53 | −53.49 | 23.18 | 1.28 |
| D-1238 | 31.17 | −33.38 | 1.70 | −12.57 |
| D-1239 | 15.59 | −59.21 | −6.06 | −21.61 |
| D-1240 | 14.47 | −42.60 | 4.23 | −12.99 |
| D-1241 | −3.73 | −15.54 | 6.14 | −4.81 |
| D-1242 | −27.39 | −44.26 | 11.51 | 12.06 |
| D-1243 | 26.82 | 64.75 | 7.28 | −30.55 |
| D-1244 | −36.97 | −53.39 | 8.20 | −18.44 |
| D-1245 | 13.97 | −59.19 | 6.09 | −5.81 |
| D-1246 | 12.21 | 13.16 | −1.62 | −24.75 |
| D-1247 | −12.88 | −32.06 | 3.88 | −6.32 |
| D-1248 | −38.80 | −68.71 | 16.29 | 12.31 |
| D-1249 | −1.75 | 6.92 | 14.79 | −13.93 |
| D-1251 | 30.27 | −79.34 | 7.61 | −20.01 |
| D-1252 | 2.23 | −50.19 | 4.37 | −3.52 |
| D-1253 | −32.85 | −29.67 | 2.99 | 2.33 |
| D-1254 | −36.45 | −76.52 | 8.02 | −21.55 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1255 | −3.39 | −64.64 | −4.77 | −14.70 |
| D-1256 | 1.01 | −3.30 | 25.61 | 14.58 |
| D-1258 | −49.01 | −54.26 | 4.65 | −6.34 |
| D-1259 | −21.83 | −49.68 | 9.72 | −2.72 |
| D-1260 | 23.21 | −65.48 | 8.03 | −4.15 |
| D-1261 | −31.64 | −57.04 | −9.89 | −13.26 |
| D-1262 | −29.72 | −66.74 | −5.61 | 15.96 |
| D-1263 | −8.33 | −65.33 | 0.08 | −11.83 |
| D-1264 | 36.01 | −20.16 | 4.61 | −14.46 |
| D-1265 | −1.65 | −51.45 | −3.48 | −6.13 |
| D-1266 | −13.01 | −19.17 | −5.06 | −8.27 |
| D-1267 | −5.05 | −31.71 | 11.97 | −0.60 |
| D-1268 | 1.11 | 10.61 | 0.33 | −5.81 |
| D-1269 | −5.56 | −53.51 | 10.62 | −3.13 |
| D-1270 | 1.10 | −60.09 | 17.57 | −2.00 |
| D-1271 | −5.05 | −68.78 | −0.50 | −21.76 |
| D-1272 | −14.37 | −50.90 | −1.83 | −18.13 |
| D-1273 | −31.36 | −62.83 | 15.04 | −1.17 |
| D-1274 | −7.69 | −21.09 | 9.88 | −0.30 |
| D-1275 | 25.07 | −72.64 | 5.58 | −25.02 |
| D-1276 | −4.59 | −35.87 | −3.35 | −11.79 |
| D-1277 | 46.09 | −35.72 | −3.63 | −25.23 |
| D-1278 | 8.53 | −70.41 | 14.59 | −19.50 |
| D-1279 | 5.96 | −4.96 | 22.09 | 28.38 |
| D-1280 | −14.29 | −58.65 | 7.86 | −3.32 |
| D-1281 | 10.07 | −32.98 | 8.49 | 0.81 |
| D-1282 | −28.56 | −74.04 | −3.80 | −35.39 |
| D-1283 | −18.30 | −34.79 | 9.14 | 2.84 |
| D-1284 | −12.11 | −36.83 | 11.05 | 4.28 |
| D-1287 | 11.71 | −21.34 | −12.29 | −28.09 |
| D-1290 | −2.13 | −78.34 | −3.56 | −11.58 |
| D-1292 | −23.43 | −28.70 | −0.57 | −16.42 |
| D-1295 | 25.46 | −57.29 | 15.12 | −1.18 |
| D-1297 | 3.21 | −63.31 | 25.77 | 22.14 |
| D-1298 | −3.92 | −68.03 | −9.71 | −34.14 |
| D-1300 | −10.33 | −49.32 | 0.97 | 2.06 |
| D-1304 | 21.30 | −10.48 | −1.29 | −11.82 |
| D-1305 | 41.65 | 13.01 | 8.80 | −1.54 |
| D-1306 | 29.33 | −7.63 | 8.81 | −6.33 |
| D-1307 | 22.31 | −29.34 | 1.52 | −13.70 |
| D-1308 | 15.60 | −20.06 | 7.53 | −4.85 |
| D-1309 | −14.33 | −52.52 | 16.98 | −9.89 |
| D-1310 | −6.36 | −76.66 | 2.35 | −10.23 |
| D-1311 | 14.29 | −65.01 | −12.32 | −29.59 |
| D-1312 | −8.48 | −79.39 | −0.42 | −14.88 |
| D-1313 | −44.04 | −74.66 | 0.67 | −4.61 |
| D-1314 | −11.91 | −43.05 | 10.02 | −5.56 |
| D-1315 | 8.16 | −46.22 | −0.32 | 2.27 |
| D-1316 | 17.17 | 27.34 | −1.49 | −3.64 |
| D-1317 | −2.23 | −55.09 | 5.58 | −11.09 |
| D-1318 | 11.27 | −47.32 | 18.80 | −7.48 |
| D-1319 | 14.66 | −25.03 | 16.29 | 13.59 |
| D-1320 | 19.79 | −0.18 | 8.88 | −7.73 |
| D-1321 | 9.10 | −76.11 | 17.02 | −0.59 |
| D-1322 | −44.56 | −69.34 | 3.57 | −13.82 |
| D-1323 | 28.21 | −15.42 | 0.41 | −11.61 |
| D-1324 | 21.72 | −62.51 | −10.04 | −6.03 |
| D-1325 | 18.72 | 0.07 | 6.16 | 4.25 |
| D-1326 | −4.10 | −72.25 | −19.37 | −33.56 |
| D-1327 | 16.07 | −68.74 | 2.99 | −16.27 |
| D-1328 | 20.37 | −69.18 | −2.32 | −18.28 |
| D-1329 | −25.32 | −44.99 | −3.16 | 3.98 |
| D-1330 | −16.33 | −63.82 | −5.69 | −16.83 |
| D-1331 | 0.99 | −35.15 | 11.59 | −7.43 |
| D-1332 | 15.23 | −53.20 | 23.43 | 7.37 |
| D-1333 | −11.93 | −39.12 | −2.27 | −4.03 |
| D-1334 | −47.27 | −65.62 | 9.21 | −3.59 |
| D-1336 | 3.44 | −18.99 | 12.97 | 3.86 |
| D-1337 | 4.67 | −67.99 | 4.05 | −14.59 |
| D-1338 | 10.50 | −20.32 | −13.20 | −27.03 |
| D-1339 | 10.45 | −57.10 | 18.11 | −5.50 |
| D-1340 | 7.50 | −75.18 | −11.35 | −51.99 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1341 | −14.13 | −42.79 | 7.28 | −2.05 |
| D-1343 | 32.45 | −74.74 | 25.44 | −8.83 |
| D-1344 | 21.49 | −79.31 | 8.57 | −41.53 |
| D-1345 | 5.56 | −71.98 | 4.40 | −14.59 |
| D-1346 | 10.84 | −47.45 | −2.43 | −21.79 |
| D-1347 | 11.85 | −38.12 | 6.72 | −16.62 |
| D-1348 | −4.77 | −76.11 | −1.17 | −20.86 |
| D-1349 | −36.51 | −61.19 | 10.46 | 11.03 |
| D-1351 | −15.32 | −73.27 | 4.78 | −8.76 |
| D-1352 | 10.36 | −63.16 | 3.64 | −5.33 |
| D-1353 | 1.21 | 8.18 | 5.23 | −10.04 |
| D-1354 | 3.34 | −75.94 | 4.23 | −15.74 |
| D-1355 | 7.71 | 11.27 | 19.92 | 11.87 |
| D-1356 | −10.85 | −63.81 | 6.34 | 0.13 |
| D-1357 | 1.31 | −37.05 | −14.02 | −16.27 |
| D-1358 | 24.49 | 41.10 | 28.13 | 20.76 |
| D-1359 | 5.56 | −23.75 | 13.20 | −2.77 |
| D-1360 | 17.08 | 37.58 | 1.08 | −11.99 |
| D-1361 | −22.77 | −47.82 | 7.21 | −9.44 |
| D-1362 | 19.55 | −59.93 | 8.97 | −23.28 |
| D-1363 | −51.44 | −77.04 | 7.78 | −22.46 |
| D-1364 | 23.06 | −10.37 | 9.40 | −4.87 |
| D-1366 | −9.36 | −51.45 | 5.94 | 6.52 |
| D-1368 | −2.29 | −52.35 | 11.55 | −12.22 |
| D-1369 | −9.85 | −46.01 | −7.70 | −10.96 |
| D-1370 | −41.93 | −78.44 | 12.97 | −28.38 |
| D-1371 | −17.16 | −36.27 | 4.02 | −4.25 |
| D-1372 | −19.19 | −63.22 | 10.94 | 7.71 |
| D-1373 | 22.27 | −76.68 | 0.97 | −24.18 |
| D-1374 | −24.95 | −73.67 | 8.54 | −38.43 |
| D-1375 | −38.52 | −63.20 | 2.67 | −9.04 |
| D-1377 | −59.82 | −77.46 | 9.62 | −16.34 |
| D-1378 | 17.43 | −27.46 | 0.08 | −1.36 |
| D-1379 | 39.59 | −77.99 | 8.65 | −21.47 |
| D-1380 | 16.50 | −68.50 | −2.57 | −24.69 |
| D-1381 | 5.13 | −34.48 | 0.49 | −0.75 |
| D-1382 | −21.97 | −80.36 | 12.13 | −23.38 |
| D-1383 | −4.29 | −46.09 | 16.86 | 1.03 |
| D-1384 | 1.74 | −78.01 | 14.64 | −24.12 |
| D-1385 | −26.66 | 15.55 | 9.21 | 4.44 |
| D-1386 | −2.76 | −22.47 | −9.79 | −16.76 |
| D-1388 | 11.93 | −28.38 | 16.90 | 18.95 |
| D-1389 | −35.23 | −75.62 | 13.47 | 3.46 |
| D-1391 | −9.54 | −55.57 | 1.76 | 8.01 |
| D-1392 | −25.60 | −69.12 | −6.44 | −31.51 |
| D-1393 | 4.95 | −72.52 | 4.21 | 0.75 |
| D-1394 | 7.16 | −77.18 | 8.33 | −7.38 |
| D-1395 | 30.60 | −72.67 | 3.81 | −29.55 |
| D-1396 | −7.43 | −77.70 | 2.43 | −28.95 |
| D-1397 | 25.07 | −80.00 | 5.34 | −32.68 |
| D-1401 | 0.05 | 6.64 | −11.54 | −12.09 |
| D-1402 | 14.85 | −66.16 | 0.32 | −2.45 |
| D-1404 | 1.69 | −41.85 | 17.51 | 0.44 |
| D-1408 | 32.66 | −74.78 | 5.23 | −9.30 |
| D-1409 | −10.30 | −74.45 | −1.58 | −32.92 |
| D-1410 | −37.77 | −55.14 | 9.16 | 4.08 |
| D-1411 | −9.71 | −61.25 | 5.83 | −11.94 |
| D-1412 | −4.40 | −62.34 | 15.06 | 1.14 |
| D-1413 | −38.99 | −26.13 | 8.91 | 13.59 |
| D-1414 | 0.68 | −48.38 | 11.08 | −5.56 |
| D-1415 | 30.11 | −79.94 | 14.79 | −8.31 |
| D-1416 | 9.00 | 72.55 | −8.25 | −27.91 |
| D-1417 | 20.52 | −1.74 | 14.23 | 4.17 |
| D-1418 | −23.30 | −66.73 | 15.23 | −0.48 |
| D-1419 | 9.36 | −78.21 | 13.31 | −33.52 |
| D-1420 | −25.30 | −63.31 | −10.54 | −25.54 |
| D-1421 | −36.82 | −71.74 | −7.14 | −31.17 |
| D-1422 | −1.31 | −72.73 | 0.50 | −31.24 |
| D-1423 | 6.97 | −32.14 | 5.77 | −0.11 |
| D-1424 | −0.05 | −25.55 | 3.32 | −13.94 |
| D-1425 | 14.42 | −32.00 | −3.96 | −15.93 |
| D-1426 | −10.30 | −22.92 | 13.20 | 2.02 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1427 | −8.53 | −61.49 | 11.51 | −10.59 |
| D-1428 | 19.28 | −18.07 | 5.43 | −4.47 |
| D-1429 | 5.81 | −78.39 | 3.48 | −41.33 |
| D-1430 | 9.87 | −77.50 | −2.26 | −28.08 |
| D-1431 | −20.64 | −79.16 | 2.76 | −35.67 |
| D-1432 | −12.59 | −48.84 | 7.21 | −14.06 |
| D-1433 | −18.88 | −77.44 | −0.49 | −19.75 |
| D-1434 | 30.88 | −31.72 | 25.22 | 7.46 |
| D-1435 | 3.97 | −79.61 | 2.51 | −31.91 |
| D-1436 | 8.08 | −71.76 | −1.08 | −28.30 |
| D-1437 | −17.56 | −72.82 | 15.27 | 8.76 |
| D-1438 | −13.50 | −49.08 | 1.49 | −14.23 |
| D-1439 | 21.43 | −63.70 | 17.18 | −0.95 |
| D-1440 | −0.52 | −65.90 | 5.51 | −21.92 |
| D-1441 | 0.09 | −38.28 | 3.85 | −9.17 |
| D-1442 | 2.66 | −55.33 | −3.43 | −26.16 |
| D-1443 | −24.24 | −30.45 | 11.54 | −0.89 |
| D-1444 | 33.58 | −65.83 | 24.85 | −0.39 |
| D-1445 | −22.79 | −16.47 | 14.20 | −7.26 |
| D-1446 | 22.30 | −16.81 | 8.46 | −8.89 |
| D-1447 | 6.18 | −68.19 | 16.29 | −11.29 |
| D-1448 | 4.01 | −49.66 | 1.54 | −7.00 |
| D-1449 | −40.41 | −15.22 | 3.08 | −10.87 |
| D-1450 | 0.77 | −77.98 | 9.78 | −23.68 |
| D-1451 | −6.58 | −69.35 | 20.12 | −8.13 |
| D-1456 | −16.75 | −79.94 | 2.10 | −14.80 |
| D-1457 | −17.33 | −80.91 | 3.56 | −39.89 |
| D-1458 | 26.04 | −29.22 | 8.57 | −4.40 |
| D-1459 | −12.84 | −76.97 | 9.47 | −15.64 |
| D-1460 | −3.29 | −76.01 | −4.45 | −25.68 |
| D-1461 | −5.61 | −77.92 | −1.70 | −19.63 |
| D-1462 | 2.08 | −63.16 | −6.72 | −26.68 |
| D-1463 | −16.61 | −67.89 | 1.09 | 2.56 |
| D-1464 | 8.48 | −54.92 | 8.11 | −14.13 |
| D-1465 | 5.76 | −71.09 | 18.59 | 0.96 |
| D-1466 | 20.46 | −37.62 | 23.18 | −2.68 |
| D-1467 | 20.32 | −13.04 | −17.34 | −15.71 |
| D-1468 | 31.45 | −64.41 | −2.19 | −4.79 |
| D-1469 | 12.68 | 5.48 | −7.28 | −20.26 |
| D-1470 | 6.92 | −66.88 | 9.38 | −12.70 |
| D-1471 | −22.22 | −74.37 | 13.02 | −13.21 |
| D-1472 | −11.81 | −79.47 | 15.36 | −19.74 |
| D-1473 | −38.46 | −72.40 | −0.17 | −21.43 |
| D-1474 | 2.97 | −57.92 | −5.19 | −16.96 |
| D-1475 | −16.93 | −44.54 | 3.65 | 2.15 |
| D-1476 | −5.89 | −52.67 | 12.80 | −3.85 |
| D-1477 | −17.89 | −60.62 | −3.68 | −2.20 |
| D-1480 | 28.79 | 10.79 | −3.24 | −16.12 |
| D-1481 | 6.70 | −41.49 | 3.35 | −21.34 |
| D-1482 | 7.43 | −19.68 | 17.91 | 6.02 |
| D-1483 | 1.98 | −21.91 | 4.90 | −5.20 |
| D-1484 | −16.51 | −55.79 | 1.51 | 6.85 |
| D-1485 | −36.43 | −80.11 | 9.81 | −11.66 |
| D-1486 | 5.42 | −62.97 | 5.50 | −13.09 |
| D-1487 | 10.89 | −23.86 | −5.81 | −11.30 |
| D-1488 | −14.71 | −68.13 | 6.06 | 5.50 |
| D-1489 | −21.55 | −76.48 | −5.83 | −18.03 |
| D-1490 | 26.04 | −80.46 | 0.57 | −46.23 |
| D-1491 | 32.72 | −80.10 | 1.78 | −26.10 |
| D-1492 | 39.08 | −37.64 | 6.69 | 4.14 |
| D-1493 | 3.54 | −74.86 | 14.02 | −7.60 |
| D-1494 | −19.75 | −43.37 | 20.10 | 2.38 |
| D-1496 | −16.08 | −70.55 | 4.54 | −21.74 |
| D-1497 | 32.26 | −81.52 | 17.58 | −27.07 |
| D-1498 | 12.11 | −40.01 | 51.46 | 25.60 |
| D-1499 | −24.39 | −79.00 | 2.34 | 4.18 |
| D-1500 | −51.56 | −70.59 | 5.02 | −16.85 |
| D-1501 | 46.47 | −65.12 | −19.40 | −28.47 |
| D-1503 | −31.92 | −69.56 | 9.89 | −10.48 |
| D-1504 | 5.50 | −37.04 | 22.85 | 5.61 |
| D-1507 | 8.48 | −55.73 | 23.50 | −8.71 |
| D-1508 | −11.65 | −68.55 | 12.47 | −16.00 |
| D-1509 | −17.76 | −55.16 | 2.07 | −15.48 |
| D-1510 | −4.36 | −29.45 | 7.68 | −3.23 |
| D-1512 | 0.33 | −33.83 | 6.40 | 5.03 |
| D-1513 | −40.09 | −64.18 | 17.24 | −2.88 |
| D-1514 | −19.65 | −33.00 | 1.86 | −10.55 |
| D-1515 | −24.63 | −55.52 | 3.73 | 0.05 |
| D-1517 | −47.61 | −74.57 | 8.95 | −9.97 |
| D-1519 | 11.56 | −29.26 | −12.37 | −18.89 |
| D-1520 | 32.24 | 3.14 | 15.60 | −0.57 |
| D-1522 | 32.14 | 8.88 | 0.97 | −13.70 |
| D-1523 | −7.43 | −50.43 | −1.00 | −11.45 |
| D-1524 | 15.49 | −8.69 | 2.02 | 0.13 |
| D-1525 | −22.79 | −63.32 | 13.36 | 7.28 |
| D-1526 | 10.45 | −12.02 | −9.30 | −17.56 |
| D-1527 | −7.16 | −39.49 | 14.64 | 10.43 |
| D-1528 | 30.78 | 16.18 | −8.65 | −26.51 |
| D-1529 | 5.41 | −34.44 | 5.52 | 9.61 |
| D-1530 | 23.04 | −14.77 | 2.10 | −12.78 |
| D-1531 | 36.53 | −1.44 | 0.50 | −11.53 |
| D-1532 | −11.19 | −22.94 | 18.16 | 2.41 |
| D-1533 | 11.38 | −70.75 | 7.78 | −6.32 |
| D-1541 | −3.76 | −50.19 | 30.21 | 23.94 |
| D-1542 | 4.74 | −17.47 | 9.54 | 1.27 |
| D-1543 | 11.93 | −76.40 | 7.70 | −42.72 |
| D-1544 | −42.33 | −52.93 | 14.69 | −0.38 |
| D-1545 | −9.67 | −41.93 | 4.13 | −9.45 |
| D-1546 | −14.76 | −71.93 | 9.54 | −7.00 |
| D-1547 | −45.14 | −63.59 | 10.29 | −7.72 |
| D-1548 | 7.53 | −32.51 | 6.85 | −8.07 |
| D-1549 | 12.78 | −59.45 | 15.20 | −24.86 |
| D-1550 | 5.96 | −73.04 | 23.10 | −3.15 |
| D-1551 | −3.17 | −50.57 | −4.48 | −10.38 |
| D-1552 | 17.08 | −3.57 | 3.49 | −13.28 |
| D-1553 | −37.67 | −70.41 | −11.02 | −23.50 |
| D-1555 | −19.85 | −47.96 | 1.54 | −8.57 |
| D-1557 | −22.96 | −65.81 | 4.46 | 6.26 |
| D-1558 | 15.05 | −10.38 | 16.99 | 13.12 |
| D-1559 | −11.13 | −11.60 | 10.59 | −5.72 |
| D-1560 | −14.95 | −70.17 | 10.29 | −4.46 |
| D-1561 | −2.81 | −53.50 | −3.31 | −23.23 |
| D-1562 | −0.90 | −70.55 | 8.91 | −2.19 |
| D-1563 | 6.74 | −36.12 | −1.70 | −11.00 |
| D-1564 | −0.33 | −76.38 | 9.89 | −9.36 |
| D-1565 | 11.74 | −70.09 | 17.57 | 3.84 |
| D-1566 | −19.26 | −36.08 | 4.12 | −20.01 |
| D-1567 | −36.21 | −26.16 | 16.33 | 8.05 |
| D-1568 | −22.17 | −29.62 | 8.89 | −0.71 |
| D-1569 | 21.63 | −2.09 | 10.46 | −5.42 |
| D-1570 | 22.11 | −76.43 | 14.14 | −32.88 |
| D-1571 | −0.82 | −37.92 | 5.89 | −14.85 |
| D-1573 | −10.18 | −64.73 | 4.44 | −1.95 |
| D-1574 | 2.61 | −35.69 | 2.26 | −15.60 |
| D-1575 | 15.97 | −5.44 | −9.22 | −15.32 |
| D-1576 | −10.11 | −49.40 | −16.68 | −16.01 |
| D-1577 | −36.79 | −70.90 | 22.18 | 3.36 |
| D-1579 | −13.84 | −42.68 | 7.44 | −10.53 |
| D-1580 | −16.15 | −0.78 | 11.21 | 1.18 |
| D-1582 | −29.33 | −70.31 | 4.61 | −9.18 |
| D-1583 | −3.91 | −72.50 | 5.83 | −22.00 |
| D-1584 | −17.49 | −69.74 | 14.91 | −4.97 |
| D-1585 | 29.70 | −51.61 | 6.85 | −9.20 |
| D-1586 | −10.36 | −24.80 | −3.64 | −14.72 |
| D-1587 | −12.24 | −16.84 | −4.32 | −14.95 |
| D-1588 | 0.39 | −1.95 | 13.34 | −2.91 |
| D-1589 | 40.88 | 0.52 | 14.26 | 6.47 |
| D-1590 | −5.61 | 22.64 | −0.97 | −7.11 |
| D-1591 | 2.31 | −30.67 | −3.48 | −13.93 |
| D-1592 | −19.75 | −38.53 | 3.55 | −6.58 |
| D-1593 | 19.01 | 6.07 | 19.17 | 16.66 |
| D-1594 | −17.20 | −57.14 | 1.44 | −15.06 |
| D-1595 | −15.97 | −57.16 | 19.00 | 7.35 |
| D-1596 | −15.98 | −42.84 | 9.16 | 8.17 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1597 | 1.66 | −71.11 | 7.27 | −23.62 |
| D-1598 | −4.22 | −63.19 | 7.03 | −6.96 |
| D-1599 | 11.04 | −39.72 | −1.13 | −20.46 |
| D-1600 | 17.62 | −38.11 | 9.86 | −16.81 |
| D-1601 | 35.77 | −77.17 | 11.75 | −26.16 |
| D-1602 | −33.82 | −69.95 | 5.89 | −13.32 |
| D-1603 | 31.45 | −71.55 | −2.35 | −30.03 |
| D-1604 | 20.89 | −1.24 | −1.30 | −9.64 |
| D-1605 | 6.55 | −53.67 | 3.48 | −9.38 |
| D-1606 | 2.69 | −23.77 | 2.27 | −1.67 |
| D-1607 | −17.91 | −51.36 | 6.31 | 10.90 |
| D-1608 | 27.20 | −32.06 | 18.56 | 3.72 |
| D-1609 | 18.06 | −19.53 | 7.54 | −5.72 |
| D-1610 | 0.29 | −5.19 | −1.21 | −14.22 |
| D-1611 | 7.55 | 36.89 | 5.34 | −0.83 |
| D-1612 | −12.84 | −19.84 | 24.77 | 13.24 |
| D-1613 | −12.97 | −75.43 | 19.45 | −2.76 |
| D-1614 | 41.14 | 37.89 | 14.31 | −4.57 |
| D-1615 | 27.30 | −41.74 | 23.10 | 14.97 |
| D-1616 | 12.94 | 3.94 | 24.94 | 30.37 |
| D-1617 | −12.74 | −28.74 | 11.92 | −7.36 |
| D-1618 | −21.59 | −33.88 | 21.75 | 9.98 |
| D-1620 | 12.43 | −59.95 | −6.31 | 6.82 |
| D-1621 | −26.08 | −48.87 | −11.78 | −11.89 |
| D-1622 | −11.28 | 6.47 | 13.22 | 4.49 |
| D-1624 | 11.89 | −55.62 | 15.64 | −2.82 |
| D-1625 | −23.14 | −30.97 | 13.42 | −0.85 |
| D-1626 | −48.99 | −63.51 | 17.15 | −3.64 |
| D-1628 | −1.56 | −38.82 | −1.09 | −13.60 |
| D-1629 | 22.68 | −43.27 | −2.76 | −9.65 |
| D-1630 | 42.94 | −59.46 | 13.31 | −0.07 |
| D-1631 | −7.87 | −61.54 | −5.43 | −11.47 |
| D-1632 | 31.45 | 40.65 | 3.40 | 1.39 |
| D-1633 | −1.02 | −42.12 | 2.32 | −10.80 |
| D-1634 | 9.14 | −31.08 | 16.35 | −8.94 |
| D-1635 | −21.74 | −62.17 | 3.57 | −6.98 |
| D-1636 | 19.09 | −24.92 | 8.88 | −24.34 |
| D-1637 | 24.00 | −50.62 | −9.16 | −13.04 |
| D-1638 | −26.95 | −66.99 | 10.06 | −9.12 |
| D-1639 | 1.01 | −36.90 | 8.95 | −4.91 |
| D-1640 | −11.91 | −64.78 | −0.16 | −9.43 |
| D-1641 | 4.60 | −48.90 | 5.64 | −16.05 |
| D-1642 | 0.58 | −41.02 | 18.35 | 1.62 |
| D-1643 | −8.85 | −76.54 | 9.54 | −15.54 |
| D-1644 | 10.51 | −52.89 | 20.58 | 14.19 |
| D-1645 | 12.87 | −71.23 | 12.16 | −0.54 |
| D-1646 | −5.78 | −74.08 | −4.69 | −27.01 |
| D-1647 | −4.45 | −5.92 | 6.63 | −8.13 |
| D-1648 | 13.46 | 34.26 | 22.88 | 4.87 |
| D-1649 | −47.63 | −56.76 | 4.12 | 8.02 |
| D-1650 | 32.58 | −59.12 | 4.05 | −9.81 |
| D-1651 | 1.84 | −64.00 | −3.73 | −17.15 |
| D-1652 | 15.30 | −41.66 | 4.28 | −10.21 |
| D-1654 | −5.23 | −33.75 | 3.00 | 3.66 |
| D-1655 | 6.87 | −42.73 | 14.47 | 8.55 |
| D-1657 | −2.37 | −52.43 | 4.98 | −15.30 |
| D-1658 | 2.03 | −18.81 | 19.00 | 8.79 |
| D-1659 | −9.57 | −59.55 | 23.74 | −15.69 |
| D-1660 | −26.48 | −74.55 | 19.78 | −2.82 |
| D-1661 | 17.81 | −38.33 | 41.55 | 0.20 |
| D-1662 | 14.45 | −52.42 | −0.59 | −27.08 |
| D-1663 | 4.07 | −58.51 | 2.59 | −16.05 |
| D-1664 | 15.20 | −53.44 | 6.39 | −8.56 |
| D-1665 | −23.06 | −68.84 | 21.96 | 14.62 |
| D-1666 | 13.84 | −40.77 | 3.64 | 2.18 |
| D-1667 | −24.50 | −45.47 | −9.04 | 6.51 |
| D-1668 | 6.61 | −78.38 | 9.62 | −24.13 |
| D-1669 | 25.32 | −65.31 | 27.36 | −27.95 |
| D-1670 | 9.53 | 20.77 | −11.62 | −24.98 |
| D-1671 | 14.18 | −38.83 | −1.66 | −12.03 |
| D-1672 | 10.69 | −42.66 | −1.83 | −19.00 |
| D-1673 | −6.87 | −12.52 | 12.45 | −2.14 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1674 | −3.44 | −30.88 | 17.10 | 12.97 |
| D-1675 | −41.19 | −75.58 | 12.13 | −15.82 |
| D-1676 | −12.87 | −60.60 | 15.24 | −7.71 |
| D-1677 | −13.84 | −38.01 | 2.26 | −9.77 |
| D-1679 | 6.72 | −42.72 | 10.87 | 1.76 |
| D-1680 | −0.82 | −58.97 | 2.49 | −4.77 |
| D-1681 | 2.40 | −70.08 | 3.89 | −16.35 |
| D-1682 | −22.79 | −48.92 | 10.87 | −4.47 |
| D-1684 | 16.50 | −50.83 | −2.16 | −13.61 |
| D-1685 | −16.42 | −79.02 | 7.62 | −61.49 |
| D-1686 | 4.79 | 74.35 | 6.72 | −13.30 |
| D-1688 | −16.27 | −49.27 | −6.81 | −19.80 |
| D-1689 | 3.43 | −73.67 | 0.91 | −18.82 |
| D-1690 | −22.68 | −21.68 | −5.75 | −7.62 |
| D-1691 | 15.82 | −72.63 | 0.75 | −33.93 |
| D-1692 | −8.53 | −65.87 | 23.18 | −2.19 |
| D-1693 | −6.53 | −52.63 | 2.49 | −13.30 |
| D-1695 | 18.62 | −73.01 | 0.73 | −16.64 |
| D-1696 | −27.53 | −41.20 | 12.86 | 11.56 |
| D-1697 | −0.63 | −76.21 | 33.11 | −5.40 |
| D-1698 | 10.73 | 5.15 | 24.35 | 24.10 |
| D-1699 | 7.59 | −49.15 | −2.19 | −15.43 |
| D-1700 | −5.47 | −42.44 | 24.90 | 13.63 |
| D-1701 | 7.02 | −9.16 | 9.08 | 5.69 |
| D-1702 | −47.80 | −24.11 | 13.81 | −4.71 |
| D-1703 | −2.85 | −61.94 | 9.13 | −4.88 |
| D-1704 | −27.90 | −8.32 | 9.89 | −13.37 |
| D-1705 | −37.01 | −46.48 | 3.32 | −9.17 |
| D-1706 | −19.28 | −32.88 | 1.70 | −8.36 |
| D-1707 | 7.69 | −21.74 | 9.05 | −6.05 |
| D-1708 | 16.50 | −57.74 | 6.64 | −3.44 |
| D-1710 | −16.79 | −65.45 | 6.80 | −10.38 |
| D-1711 | −28.36 | −56.25 | 7.76 | −4.87 |
| D-1712 | 17.37 | −18.44 | 3.32 | −13.05 |
| D-1714 | 26.79 | −33.16 | 7.78 | −4.00 |
| D-1715 | 4.22 | −53.78 | 11.83 | −10.35 |
| D-1717 | 0.87 | −57.74 | 7.92 | −3.01 |
| D-1718 | 35.62 | −38.40 | −0.40 | −11.07 |
| D-1720 | −5.71 | −66.00 | 5.50 | −9.46 |
| D-1721 | 29.47 | 45.96 | 20.42 | 15.01 |
| D-1723 | 9.72 | −28.91 | 0.00 | −30.34 |
| D-1724 | −9.58 | −71.18 | 3.80 | −9.56 |
| D-1725 | −12.29 | −58.30 | 5.17 | −5.90 |
| D-1726 | 18.53 | 8.84 | 8.13 | −5.66 |
| D-1727 | −8.35 | −79.86 | 14.31 | −27.31 |
| D-1728 | −14.50 | −78.33 | 6.36 | −27.01 |
| D-1729 | 17.39 | −6.03 | 29.92 | 11.54 |
| D-1730 | −45.31 | −77.60 | 20.83 | 1.51 |
| D-1731 | 15.79 | −18.18 | 1.78 | −9.77 |
| D-1732 | −16.21 | −4.72 | 17.10 | 4.67 |
| D-1733 | −0.64 | −75.43 | 17.74 | −13.23 |
| D-1735 | 16.55 | −62.74 | 7.52 | −11.28 |
| D-1736 | −19.47 | −52.32 | −3.00 | −9.23 |
| D-1737 | 5.41 | −9.57 | 25.94 | 15.76 |
| D-1738 | 5.35 | −35.18 | 15.13 | −10.09 |
| D-1739 | −10.18 | −57.04 | 15.48 | −15.92 |
| D-1740 | 10.75 | −73.85 | 0.42 | −21.93 |
| D-1742 | 13.07 | −19.18 | −4.93 | −6.50 |
| D-1743 | −2.56 | −27.26 | −4.73 | −11.73 |
| D-1744 | −7.60 | −70.94 | 10.71 | −1.73 |
| D-1745 | −1.21 | −44.21 | 1.16 | −15.57 |
| D-1746 | −19.08 | −74.88 | 14.64 | −18.38 |
| D-1747 | 6.70 | 16.51 | 0.42 | −12.56 |
| D-1749 | 2.52 | −40.74 | 10.35 | 2.28 |
| D-1751 | 2.95 | −76.84 | 7.05 | −18.50 |
| D-1753 | 2.02 | 15.57 | 12.97 | 19.69 |
| D-1754 | 17.30 | −1.58 | −7.05 | −21.69 |
| D-1755 | −20.55 | −74.51 | 8.79 | −16.00 |
| D-1756 | −45.60 | −12.19 | 16.17 | −1.67 |
| D-1757 | −26.04 | −61.16 | 12.21 | −7.81 |
| D-1758 | −0.34 | −73.97 | 47.63 | −8.80 |
| D-1759 | −63.51 | −69.49 | −24.07 | −41.37 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1760 | 5.76 | −43.12 | −0.91 | −9.97 |
| D-1761 | 42.43 | −57.23 | 18.09 | 8.26 |
| D-1762 | 0.10 | −69.14 | 10.67 | −6.73 |
| D-1763 | −5.81 | −62.90 | 34.11 | 14.42 |
| D-1764 | 6.21 | −72.39 | 5.92 | −22.06 |
| D-1765 | −11.10 | −37.69 | −1.76 | −2.05 |
| D-1766 | 0.52 | 4.89 | 14.20 | −11.31 |
| D-1767 | 18.43 | −46.54 | 19.50 | 0.02 |
| D-1768 | 12.02 | −74.19 | 2.92 | −14.64 |
| D-1769 | −0.34 | −55.25 | −2.90 | −21.94 |
| D-1770 | 3.43 | −35.46 | 1.33 | −9.24 |
| D-1771 | −1.18 | −35.96 | 18.93 | −2.23 |
| D-1772 | −32.57 | −78.62 | 60.42 | 3.61 |
| D-1774 | 24.50 | −76.51 | 20.00 | −23.79 |
| D-1775 | 21.92 | −1.67 | 20.58 | 3.16 |
| D-1776 | −0.64 | −69.08 | 3.51 | −14.00 |
| D-1778 | 14.85 | −43.29 | 7.13 | 3.09 |
| D-1779 | 45.23 | 9.53 | 7.47 | −2.55 |
| D-1780 | 6.36 | −53.12 | 16.21 | 5.81 |
| D-1781 | −9.63 | −55.20 | 3.01 | −13.99 |
| D-1782 | −7.40 | −37.94 | −2.35 | −13.41 |
| D-1783 | −11.80 | −39.91 | 15.38 | −0.50 |
| D-1784 | −27.14 | −62.76 | 7.72 | −15.32 |
| D-1785 | −24.69 | −56.81 | 0.57 | −20.48 |
| D-1786 | −53.14 | −57.69 | 7.62 | −13.19 |
| D-1787 | −1.98 | −67.56 | 14.61 | −14.64 |
| D-1788 | 22.85 | −27.66 | 11.40 | −4.65 |
| D-1789 | −57.57 | −60.25 | 3.65 | −2.84 |
| D-1790 | 18.68 | −77.95 | 16.25 | −18.72 |
| D-1791 | −7.31 | −74.76 | 15.24 | −6.11 |
| D-1793 | 28.65 | 16.33 | 12.45 | 5.71 |
| D-1794 | −17.68 | −20.87 | 1.46 | −7.31 |
| D-1795 | 17.95 | −73.95 | −1.74 | −27.64 |
| D-1796 | 5.95 | −23.80 | 7.30 | −7.46 |
| D-1797 | −6.72 | −51.09 | 11.70 | −3.05 |
| D-1798 | 12.40 | −2.59 | −8.59 | −8.33 |
| D-1799 | 8.91 | −59.33 | −2.27 | −19.09 |
| D-1800 | 18.52 | 17.09 | 2.45 | −4.63 |
| D-1801 | −18.92 | −22.39 | 11.12 | −12.94 |
| D-1802 | −3.58 | −78.22 | 2.34 | −13.75 |
| D-1803 | 7.69 | −66.70 | −0.66 | −17.72 |
| D-1804 | −22.94 | −78.51 | 16.40 | −15.98 |
| D-1805 | 12.14 | −36.01 | 17.76 | 9.49 |
| D-1806 | −10.65 | −73.01 | −1.86 | −36.31 |
| D-1809 | −2.23 | −62.22 | −3.38 | −12.14 |
| D-1810 | 2.27 | −50.18 | −7.88 | −12.36 |
| D-1811 | 20.62 | −78.33 | 10.83 | −4.71 |
| D-1812 | 6.46 | −63.75 | 15.80 | 5.89 |
| D-1813 | 26.26 | −34.46 | 3.24 | −5.20 |
| D-1815 | 21.72 | 24.33 | −0.91 | −15.26 |
| D-1816 | −1.27 | −62.68 | 0.65 | −15.01 |
| D-1817 | −37.56 | −48.82 | −8.49 | −10.71 |
| D-1818 | −20.79 | −49.64 | 0.32 | −14.74 |
| D-1820 | 1.94 | −66.41 | −12.77 | −12.94 |
| D-1821 | −27.34 | −55.96 | −5.69 | −15.96 |
| D-1822 | 15.72 | −13.71 | 5.89 | −8.21 |
| D-1823 | 36.98 | −54.48 | 7.03 | −7.59 |
| D-1824 | 15.05 | −38.99 | 12.20 | −4.28 |
| D-1825 | −17.23 | −62.99 | 17.95 | −0.48 |
| D-1826 | −1.74 | −79.64 | 8.73 | −30.66 |
| D-1827 | −9.29 | −36.07 | 0.00 | −8.87 |
| D-1828 | 32.08 | −63.24 | −1.16 | −20.15 |
| D-1829 | −12.97 | −80.27 | 17.54 | −16.16 |
| D-1830 | −18.62 | −21.58 | 0.81 | −16.10 |
| D-1831 | −25.78 | −74.69 | 16.99 | −12.92 |
| D-1832 | 9.24 | 16.76 | −10.29 | −21.96 |
| D-1833 | 31.56 | −68.81 | 13.34 | −1.42 |
| D-1834 | −10.26 | −74.52 | −1.21 | −27.17 |
| D-1835 | −12.48 | −67.28 | 3.77 | 0.84 |
| D-1836 | −13.17 | −7.34 | 20.13 | 17.39 |
| D-1837 | −11.36 | −20.19 | 3.48 | 4.61 |
| D-1838 | −14.31 | −32.03 | 14.06 | 1.71 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1839 | 10.51 | −63.37 | 11.43 | −5.04 |
| D-1841 | −16.26 | −72.93 | −5.25 | −20.49 |
| D-1843 | −46.20 | −72.45 | 7.14 | −13.01 |
| D-1844 | −4.79 | −42.61 | 15.60 | 9.77 |
| D-1845 | 35.78 | −30.99 | 15.31 | −11.75 |
| D-1846 | 30.49 | −44.75 | 4.53 | −10.21 |
| D-1847 | 13.03 | −44.91 | 9.72 | −12.37 |
| D-1849 | 4.40 | −50.27 | 4.32 | −11.51 |
| D-1850 | 22.87 | −19.62 | 9.48 | 2.97 |
| D-1851 | 10.16 | −50.32 | 10.83 | −2.40 |
| D-1852 | −2.03 | 3.30 | 6.39 | −10.53 |
| D-1853 | 8.76 | −34.41 | 11.54 | −0.96 |
| D-1854 | −10.75 | −32.54 | 1.86 | −1.55 |
| D-1855 | 6.49 | −75.79 | 9.86 | −13.88 |
| D-1856 | −11.66 | −70.52 | −4.07 | −27.14 |
| D-1857 | −7.50 | −2.38 | 13.44 | −5.69 |
| D-1858 | 13.63 | −54.80 | 2.27 | −14.00 |
| D-1859 | −17.17 | −75.64 | 6.56 | −17.77 |
| D-1860 | 6.58 | −76.19 | −5.16 | −13.59 |
| D-1861 | 19.57 | −39.30 | 16.86 | 13.06 |
| D-1862 | −5.71 | −73.94 | 4.85 | −8.72 |
| D-1863 | −47.23 | −81.66 | 41.00 | −8.60 |
| D-1864 | 23.90 | −75.44 | −0.16 | −26.92 |
| D-1865 | −2.85 | −33.66 | 17.34 | −7.39 |
| D-1866 | −41.34 | −73.70 | 4.20 | −7.31 |
| D-1867 | 7.01 | −43.86 | 23.49 | −4.81 |
| D-1868 | 27.33 | −45.04 | −15.44 | −23.60 |
| D-1869 | −2.02 | −38.29 | 16.32 | 0.19 |
| D-1870 | −3.25 | −72.86 | −3.89 | −33.61 |
| D-1871 | 6.24 | −59.17 | 6.53 | −8.23 |
| D-1872 | 6.06 | 12.20 | 27.36 | 18.31 |
| D-1873 | −19.65 | −62.34 | 3.15 | −7.44 |
| D-1875 | 11.66 | −45.27 | 6.22 | −6.88 |
| D-1877 | 28.40 | −51.53 | 4.40 | −19.08 |
| D-1878 | −13.50 | −29.09 | 5.98 | −8.53 |
| D-1879 | 1.09 | −29.39 | 12.09 | −9.43 |
| D-1880 | −2.56 | −47.80 | −0.17 | −6.36 |
| D-1881 | 58.17 | −50.55 | −2.26 | −19.24 |
| D-1882 | −26.82 | −47.71 | 2.51 | 10.76 |
| D-1883 | −22.50 | −13.68 | −13.61 | −21.06 |
| D-1884 | −2.70 | −35.00 | 19.02 | −4.66 |
| D-1885 | −7.50 | −73.19 | −4.56 | −34.52 |
| D-1886 | −8.82 | −20.72 | 6.89 | 11.71 |
| D-1887 | 11.23 | −66.61 | 1.94 | −17.52 |
| D-1888 | −4.79 | −17.84 | 6.06 | −4.70 |
| D-1889 | 7.59 | −57.31 | 15.07 | −11.89 |
| D-1890 | −32.37 | −68.00 | −4.48 | −15.63 |
| D-1891 | 38.80 | −18.11 | 5.75 | −12.54 |
| D-1892 | 3.63 | −9.46 | 9.72 | 12.53 |
| D-1893 | 5.33 | −62.04 | 13.70 | 8.34 |
| D-1894 | −16.08 | −66.91 | −3.48 | −18.47 |
| D-1895 | −39.37 | −54.73 | 10.65 | −3.04 |
| D-1896 | −34.17 | −68.67 | 20.94 | 2.68 |
| D-1897 | −12.55 | −79.14 | −1.18 | −30.09 |
| D-1898 | −6.96 | −68.28 | −1.78 | −18.90 |
| D-1899 | 20.72 | 26.23 | −11.80 | −14.61 |
| D-1900 | −3.73 | −64.22 | −2.82 | −23.57 |
| D-1901 | 6.36 | −58.44 | 5.35 | −2.99 |
| D-1902 | 1.26 | 21.40 | 23.69 | 10.04 |
| D-1903 | 3.94 | −74.24 | −0.25 | −14.16 |
| D-1904 | 0.68 | 50.23 | 2.51 | −9.54 |
| D-1905 | −19.08 | −76.82 | 10.88 | −17.12 |
| D-1906 | 17.08 | −43.53 | 9.46 | −4.79 |
| D-1907 | −19.00 | −52.03 | 0.34 | −20.98 |
| D-1908 | −21.93 | −49.22 | 18.58 | 14.88 |
| D-1909 | 17.59 | 12.47 | 0.41 | −5.27 |
| D-1910 | 12.10 | −37.19 | 2.43 | −10.38 |
| D-1911 | 4.31 | −60.58 | 19.92 | 7.26 |
| D-1912 | −7.69 | −34.13 | 2.59 | −5.43 |
| D-1913 | 4.68 | −7.14 | 21.84 | 10.42 |
| D-1914 | −9.95 | −40.94 | 20.02 | 0.05 |
| D-1915 | −9.20 | −12.41 | 0.40 | −10.13 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1916 | −90.09 | −69.70 | 1.42 | 10.86 |
| D-1917 | 7.80 | −21.88 | 21.09 | 3.31 |
| D-1918 | −13.11 | −77.48 | 6.72 | −61.74 |
| D-1919 | 0.14 | −38.79 | −5.67 | −17.31 |
| D-1920 | −29.72 | −58.58 | 19.83 | 9.16 |
| D-1921 | −12.68 | −59.75 | 1.05 | −14.09 |
| D-1922 | −19.56 | −54.13 | 6.68 | −10.08 |
| D-1923 | −5.61 | −43.21 | 16.29 | 12.59 |
| D-1924 | 12.82 | −72.06 | 17.18 | −2.29 |
| D-1925 | 16.97 | −17.78 | 19.41 | −2.83 |
| D-1926 | −15.49 | −11.77 | 68.39 | −20.57 |
| D-1927 | 11.32 | 4.87 | −4.40 | −23.95 |
| D-1928 | −6.06 | −28.46 | 24.85 | 9.59 |
| D-1930 | −6.58 | −79.22 | 17.16 | −29.12 |
| D-1931 | −3.39 | −62.32 | 5.61 | −16.80 |
| D-1932 | 9.76 | −2.23 | 10.05 | 7.37 |
| D-1933 | 4.31 | −53.82 | 5.06 | −1.69 |
| D-1934 | −14.29 | −22.36 | 15.56 | 8.75 |
| D-1935 | −3.85 | −49.95 | 2.34 | −6.40 |
| D-1936 | −9.91 | 22.02 | 0.59 | −6.11 |
| D-1937 | −3.73 | −61.11 | 4.32 | −21.53 |
| D-1938 | −35.33 | −77.39 | −7.36 | −22.69 |
| D-1939 | 11.46 | 7.47 | 3.24 | −6.37 |
| D-1940 | −42.29 | −45.97 | 12.47 | −5.61 |
| D-1941 | −8.16 | −45.74 | −2.27 | −7.42 |
| D-1942 | −3.00 | −55.85 | 16.65 | −10.14 |
| D-1943 | 33.68 | −31.48 | 3.72 | −12.52 |
| D-1944 | 11.42 | −58.08 | 3.04 | −16.01 |
| D-1945 | −31.07 | −68.98 | 10.70 | −6.84 |
| D-1946 | −36.79 | −48.50 | 19.41 | 12.95 |
| D-1947 | 5.52 | −18.81 | −7.54 | −11.92 |
| D-1948 | 0.24 | −72.84 | 12.53 | 1.26 |
| D-1949 | 22.59 | 8.84 | 14.94 | −0.84 |
| D-1950 | 19.69 | 13.83 | 0.08 | −9.03 |
| D-1951 | −23.67 | −77.04 | 2.43 | −12.37 |
| D-1952 | −25.79 | −72.15 | 7.29 | 4.56 |
| D-1953 | −41.63 | −54.76 | −4.37 | −19.62 |
| D-1954 | −16.50 | −74.90 | 26.47 | −9.31 |
| D-1955 | −21.01 | −16.60 | 16.01 | 9.73 |
| D-1956 | −8.95 | −74.13 | 13.94 | −22.70 |
| D-1957 | −15.05 | −73.45 | 19.25 | −5.72 |
| D-1958 | −17.04 | −42.99 | −8.57 | −21.64 |
| D-1959 | −0.24 | −74.53 | 10.37 | −52.59 |
| D-1960 | 5.66 | −39.86 | 0.50 | −6.53 |
| D-1961 | −15.14 | −39.35 | 4.27 | 3.43 |
| D-1962 | 15.69 | −64.81 | 3.10 | −12.12 |
| D-1963 | 0.62 | −55.52 | −5.16 | −14.03 |
| D-1964 | −16.11 | −8.15 | 4.15 | 0.01 |
| D-1965 | 18.91 | −68.13 | 16.29 | 5.58 |
| D-1966 | 7.31 | −66.61 | 18.67 | 2.02 |
| D-1967 | −31.59 | −27.69 | −1.33 | −18.19 |
| D-1968 | 14.95 | −50.53 | 10.04 | 2.00 |
| D-1969 | −39.37 | −49.73 | 11.83 | 3.08 |
| D-1970 | −30.04 | −71.01 | 10.46 | −3.76 |
| D-1971 | −1.36 | −0.35 | 7.76 | −3.39 |
| D-1972 | −10.99 | 92.17 | 5.92 | 8.11 |
| D-1973 | −26.54 | −38.10 | 1.22 | −7.75 |
| D-1974 | 14.04 | −47.50 | 8.73 | −4.02 |
| D-1976 | −14.47 | −28.64 | 10.05 | 2.14 |
| D-1977 | 13.03 | −14.91 | 6.78 | 8.02 |
| D-1978 | −17.61 | −72.14 | −0.25 | −34.74 |
| D-1979 | 12.20 | −66.67 | 0.40 | −20.96 |
| D-1980 | 4.78 | −7.88 | 8.03 | −4.08 |
| D-1981 | 22.46 | −78.74 | 11.96 | −23.68 |
| D-1982 | 7.06 | −42.71 | 13.64 | −14.16 |
| D-1983 | 147.43 | −45.73 | 7.46 | 4.83 |
| D-1984 | −9.43 | −56.18 | 18.85 | 8.40 |
| D-1985 | −7.26 | −78.52 | −2.18 | −23.49 |
| D-1986 | 11.55 | −54.27 | 10.78 | −0.74 |
| D-1988 | 18.49 | −80.12 | −1.70 | −32.09 |
| D-1989 | 32.04 | −77.89 | 18.27 | 2.40 |
| D-1990 | 17.46 | −18.79 | 3.90 | −13.24 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1991 | −7.01 | −59.92 | 1.99 | −11.66 |
| D-1992 | −82.84 | −61.20 | −12.64 | 2.49 |
| D-1993 | −9.27 | −46.43 | −3.01 | −10.66 |
| D-1995 | −0.19 | −75.26 | −6.87 | −30.20 |
| D-1996 | −11.66 | −50.74 | −13.03 | −29.47 |
| D-1997 | −25.96 | −44.39 | −5.94 | −21.93 |
| D-1998 | 19.63 | −42.79 | 14.23 | −2.70 |
| D-1999 | 3.87 | −79.84 | 21.26 | −32.79 |
| D-2000 | 5.27 | −19.03 | 1.00 | −3.02 |
| D-2001 | −15.70 | −39.55 | −3.40 | −20.23 |
| D-2002 | −0.19 | −12.14 | 1.13 | −15.73 |
| D-2003 | −9.36 | −42.27 | 3.51 | −10.63 |
| D-2004 | 19.17 | −13.09 | −0.59 | −8.71 |
| D-2005 | 27.82 | −62.21 | 4.40 | −23.84 |
| D-2006 | 7.31 | −26.36 | 9.24 | 3.49 |
| D-2007 | −52.29 | −25.86 | −13.89 | 0.39 |
| D-2009 | 15.41 | −56.60 | 30.54 | 4.40 |
| D-2011 | 5.07 | −7.16 | 0.42 | 6.12 |
| D-2012 | 3.49 | 14.31 | 9.62 | 5.80 |
| D-2013 | 29.17 | −28.96 | 10.62 | −13.66 |
| D-2014 | −9.43 | −56.66 | 23.92 | 3.59 |
| D-2015 | −5.66 | −13.26 | −4.48 | −19.19 |
| D-2016 | −7.79 | −48.27 | 6.22 | −11.50 |
| D-2017 | −29.08 | −10.09 | 8.46 | 6.59 |
| D-2018 | −12.29 | −42.04 | 5.01 | −18.67 |
| D-2019 | −9.38 | −27.60 | 2.27 | 3.19 |
| D-2020 | 5.41 | −67.72 | 14.31 | −3.73 |
| D-2022 | 6.39 | −35.46 | 6.31 | −0.92 |
| D-2023 | 19.27 | −72.15 | 26.28 | −23.46 |
| D-2024 | 4.76 | −55.12 | 10.21 | 8.48 |
| D-2025 | 24.01 | 0.84 | 5.82 | −4.60 |
| D-2026 | −9.82 | −31.92 | 13.44 | 2.43 |
| D-2027 | −10.47 | −39.71 | −13.78 | −16.75 |
| D-2028 | 25.85 | −25.14 | 7.11 | 6.77 |
| D-2029 | 9.58 | −27.90 | 18.84 | −6.92 |
| D-2030 | 25.17 | −4.33 | −1.05 | −8.23 |
| D-2031 | −46.06 | −61.25 | 15.98 | −1.88 |
| D-2032 | −1.28 | −54.49 | −8.62 | −19.41 |
| D-2033 | 37.48 | −27.95 | −7.46 | −21.48 |
| D-2034 | 20.28 | 33.72 | 6.95 | 3.41 |
| D-2035 | −27.81 | −53.97 | 19.10 | −7.38 |
| D-2036 | 9.78 | −59.60 | 8.25 | −7.34 |
| D-2037 | −16.17 | −59.12 | 14.10 | 4.42 |
| D-2038 | −2.48 | −78.15 | 26.11 | −3.69 |
| D-2039 | −17.52 | −77.24 | 4.94 | −0.89 |
| D-2040 | −7.25 | −54.11 | 11.63 | 0.72 |
| D-2041 | 9.57 | −11.47 | −7.05 | −6.10 |
| D-2042 | −18.34 | −29.19 | −1.05 | −8.78 |
| D-2043 | −3.12 | −66.07 | 11.63 | 1.50 |
| D-2044 | −37.56 | −32.28 | 21.91 | 8.04 |
| D-2045 | −22.65 | −75.89 | 2.02 | −21.05 |
| D-2046 | −13.91 | −74.75 | −1.46 | −20.68 |
| D-2047 | −16.88 | −53.39 | −9.96 | −30.30 |
| D-2048 | −13.58 | −76.86 | 16.90 | −27.20 |
| D-2049 | −36.21 | −9.07 | 7.60 | 5.07 |
| D-2051 | 2.56 | −51.79 | 3.24 | −1.81 |
| D-2052 | −18.34 | −46.56 | 12.48 | 15.60 |
| D-2053 | 20.23 | −39.84 | 3.72 | −13.74 |
| D-2055 | 7.15 | −78.38 | 7.69 | −15.41 |
| D-2056 | −2.39 | −26.69 | 17.99 | 7.25 |
| D-2057 | −3.21 | −61.15 | 1.76 | −13.42 |
| D-2058 | 15.87 | −21.62 | 3.63 | −12.54 |
| D-2060 | −48.44 | −77.63 | 6.86 | −42.35 |
| D-2061 | 14.50 | −79.48 | 19.67 | −3.72 |
| D-2062 | −16.59 | −70.67 | −3.65 | −21.31 |
| D-2063 | −7.01 | −76.15 | 9.71 | −28.36 |
| D-2065 | −4.40 | 14.16 | 14.19 | 0.97 |
| D-2067 | 21.53 | 3.99 | −8.46 | −21.68 |
| D-2068 | 23.43 | −75.39 | −3.40 | −26.63 |
| D-2069 | 2.42 | −79.04 | 22.39 | −11.16 |
| D-2070 | 9.38 | −61.91 | 19.53 | −0.10 |
| D-2071 | 0.52 | −65.61 | 9.08 | 7.54 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2072 | −5.23 | −78.42 | 7.28 | −24.05 |
| D-2073 | 22.59 | −3.89 | 21.08 | 10.82 |
| D-2074 | 21.01 | −72.33 | 3.07 | −21.93 |
| D-2075 | 30.14 | −58.62 | −3.65 | −14.55 |
| D-2076 | 5.13 | −54.39 | 17.95 | −0.94 |
| D-2077 | 5.76 | −53.36 | −6.31 | −22.62 |
| D-2078 | −2.95 | −27.45 | 5.31 | −6.53 |
| D-2079 | −9.00 | −76.93 | −1.94 | −18.14 |
| D-2080 | −20.91 | −41.76 | 18.51 | 2.13 |
| D-2082 | 1.38 | −3.34 | 1.76 | −12.55 |
| D-2083 | 13.85 | 12.36 | 23.10 | 10.70 |
| D-2084 | 4.26 | −45.51 | 3.64 | −5.08 |
| D-2085 | −21.45 | −69.45 | −1.70 | −12.65 |
| D-2086 | 14.31 | −25.67 | 5.19 | −9.77 |
| D-2087 | −10.64 | −72.79 | 11.30 | −7.89 |
| D-2088 | 33.03 | −49.42 | 11.55 | −4.08 |
| D-2089 | −12.31 | −71.20 | −0.16 | −12.87 |
| D-2090 | 2.23 | −13.02 | 4.53 | −8.06 |
| D-2091 | 5.50 | −30.25 | 3.26 | −8.25 |
| D-2092 | 25.21 | 9.46 | 26.06 | 9.99 |
| D-2093 | −30.01 | −56.61 | −2.51 | −10.01 |
| D-2094 | 3.24 | −50.65 | 12.20 | −1.38 |
| D-2096 | −7.87 | −47.43 | −6.81 | −18.01 |
| D-2097 | 3.08 | −48.50 | −3.72 | −12.37 |
| D-2098 | −5.85 | −44.10 | −15.52 | −16.11 |
| D-2099 | 1.74 | −30.12 | 27.36 | 8.16 |
| D-2100 | −1.85 | −27.99 | −0.85 | −15.43 |
| D-2101 | 9.57 | −15.62 | −13.37 | −32.49 |
| D-2102 | 17.20 | −17.54 | 8.11 | −13.47 |
| D-2103 | 18.26 | −14.51 | 19.92 | −2.74 |
| D-2104 | −20.60 | −52.42 | 15.88 | 9.47 |
| D-2105 | −13.44 | −36.40 | 0.16 | −2.69 |
| D-2106 | 7.45 | −24.35 | −6.14 | −8.94 |
| D-2108 | −26.79 | −47.50 | 8.03 | −6.12 |
| D-2109 | 28.75 | −61.84 | 7.03 | −18.38 |
| D-2110 | −15.98 | −64.33 | 11.83 | −4.94 |
| D-2111 | 3.58 | −25.27 | 11.63 | −0.29 |
| D-2112 | −30.49 | −70.57 | −7.11 | −23.03 |
| D-2113 | −21.34 | −45.95 | −7.97 | −11.53 |
| D-2114 | 2.37 | −38.94 | 15.52 | 4.19 |
| D-2116 | 0.77 | −16.52 | 7.68 | 0.82 |
| D-2117 | −34.56 | −77.15 | −0.97 | −27.34 |
| D-2118 | 39.37 | 1.68 | 17.34 | 4.87 |
| D-2119 | 35.75 | −62.09 | 19.42 | −3.86 |
| D-2120 | −15.98 | −37.99 | −3.57 | −10.72 |
| D-2121 | −20.70 | −45.64 | −0.65 | −0.80 |
| D-2122 | −28.27 | −75.45 | −8.49 | −10.90 |
| D-2123 | −3.00 | −30.45 | −12.77 | −21.76 |
| D-2125 | −20.37 | −46.48 | 12.20 | −8.72 |
| D-2126 | 15.87 | −14.95 | 15.23 | −8.82 |
| D-2127 | −14.04 | −41.88 | −0.89 | −20.13 |
| D-2128 | −0.37 | −32.88 | 9.54 | 6.92 |
| D-2129 | −5.66 | −42.51 | 2.74 | −16.04 |
| D-2131 | −5.23 | −60.82 | 17.74 | 0.02 |
| D-2132 | −7.91 | −58.89 | 14.37 | −3.66 |
| D-2135 | −9.68 | −76.64 | 10.59 | 1.08 |
| D-2138 | 32.66 | −43.04 | 15.77 | 3.66 |
| D-2139 | −6.65 | −37.39 | 10.37 | 0.22 |
| D-2140 | −12.02 | −44.16 | 2.93 | −13.13 |
| D-2141 | −25.79 | −65.81 | 0.00 | −3.03 |
| D-2142 | 18.26 | −9.97 | 11.72 | 12.29 |
| D-2143 | −40.37 | −41.64 | 10.54 | 6.24 |
| D-2144 | 17.30 | −77.66 | −0.73 | −30.74 |
| D-2145 | 15.14 | −73.75 | 7.55 | −20.41 |
| D-2146 | −12.43 | −66.84 | 9.71 | −17.02 |
| D-2147 | −2.79 | −80.26 | 8.20 | −11.80 |
| D-2148 | −13.12 | −50.55 | 6.17 | −16.80 |
| D-2149 | −14.10 | −73.21 | 1.05 | −16.43 |
| D-2150 | 8.57 | −11.20 | −2.20 | −15.48 |
| D-2151 | 3.25 | 16.20 | −11.67 | −16.45 |
| D-2152 | −27.82 | −27.09 | 3.07 | −9.90 |
| D-2153 | −8.20 | −28.11 | 14.71 | 2.34 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2154 | 8.26 | −57.95 | 5.69 | −6.42 |
| D-2155 | 29.28 | −26.90 | −0.16 | −8.87 |
| D-2156 | −8.63 | −39.94 | 4.29 | −1.85 |
| D-2157 | 40.98 | −49.72 | 15.81 | −7.89 |
| D-2158 | 1.27 | −64.90 | −20.18 | −19.77 |
| D-2159 | −11.46 | −62.75 | −5.51 | −19.74 |
| D-2160 | 4.74 | −52.84 | −2.34 | −16.92 |
| D-2161 | 51.01 | −43.91 | 6.03 | −11.46 |
| D-2162 | −10.09 | −45.16 | 5.61 | −2.10 |
| D-2163 | 3.12 | −48.22 | 51.05 | 6.96 |
| D-2164 | 39.79 | −69.13 | 8.00 | −19.97 |
| D-2165 | −0.53 | −74.56 | −4.32 | −27.16 |
| D-2166 | −2.18 | −65.81 | 11.45 | −16.77 |
| D-2167 | 24.40 | −53.07 | 27.98 | 16.39 |
| D-2168 | −25.14 | −30.88 | 7.53 | 5.06 |
| D-2169 | 7.45 | −56.17 | 16.17 | 2.89 |
| D-2170 | −37.06 | −62.46 | 6.69 | −14.30 |
| D-2171 | 0.90 | −53.35 | −5.11 | −15.32 |
| D-2173 | 39.14 | 5.84 | 12.37 | 8.02 |
| D-2175 | 1.55 | −63.15 | −1.46 | −11.53 |
| D-2176 | 8.07 | 48.04 | −6.19 | −6.21 |
| D-2177 | 18.72 | 22.15 | 4.54 | −9.19 |
| D-2178 | −10.11 | 0.12 | −0.66 | −4.23 |
| D-2179 | 0.00 | −27.63 | 1.62 | −13.12 |
| D-2180 | 11.04 | 13.22 | 0.17 | −3.68 |
| D-2181 | −28.17 | −16.03 | 2.76 | −10.31 |
| D-2182 | −25.91 | −41.36 | 0.08 | −11.30 |
| D-2183 | 24.88 | −43.72 | −2.67 | −10.89 |
| D-2184 | 18.20 | 18.68 | 11.96 | 11.68 |
| D-2185 | −20.32 | −41.43 | −7.54 | −26.81 |
| D-2186 | −10.37 | −73.28 | 11.38 | −12.70 |
| D-2187 | 19.46 | −20.05 | 10.59 | 10.67 |
| D-2188 | 1.02 | −70.09 | −1.74 | −15.96 |
| D-2189 | −14.50 | −38.26 | 1.42 | −14.19 |
| D-2190 | −18.24 | −61.71 | −9.79 | −17.99 |
| D-2191 | −15.04 | −62.87 | 15.80 | 4.20 |
| D-2193 | 9.58 | −59.04 | 7.44 | −1.72 |
| D-2194 | −11.18 | −44.01 | 14.69 | −2.00 |
| D-2195 | 19.07 | −44.55 | 15.76 | 5.22 |
| D-2197 | 13.12 | −25.85 | 6.61 | −12.79 |
| D-2198 | −4.68 | −35.17 | 4.02 | −10.32 |
| D-2199 | −8.27 | −48.07 | 14.61 | −3.49 |
| D-2201 | 12.39 | −68.13 | 13.26 | −8.12 |
| D-2203 | 5.96 | −47.61 | 22.26 | −0.47 |
| D-2204 | 17.20 | −2.70 | 14.12 | −7.52 |
| D-2205 | −0.37 | −2.53 | 3.93 | 0.78 |
| D-2206 | −1.94 | −36.37 | 16.57 | −4.49 |
| D-2207 | −34.95 | −53.37 | 19.41 | −3.59 |
| D-2208 | 15.05 | −61.50 | 8.37 | −14.17 |
| D-2209 | 21.64 | −73.66 | −10.21 | −41.26 |
| D-2211 | −30.08 | −42.14 | 9.89 | −7.13 |
| D-2212 | 29.46 | −73.39 | 7.72 | −15.28 |
| D-2213 | 2.69 | −46.37 | 1.86 | 8.25 |
| D-2214 | 38.33 | −53.84 | −5.92 | −11.50 |
| D-2215 | −23.67 | −54.98 | 17.74 | 2.12 |
| D-2216 | −55.59 | −72.78 | 1.86 | −11.28 |
| D-2217 | 29.27 | −69.54 | 14.23 | −22.52 |
| D-2218 | −26.43 | −76.79 | −6.39 | −27.46 |
| D-2219 | −10.55 | −50.41 | 7.52 | −16.12 |
| D-2220 | 5.52 | −13.82 | −3.40 | −2.47 |
| D-2221 | 30.40 | −61.88 | −2.59 | −19.75 |
| D-2222 | 43.30 | −48.47 | 4.32 | −3.69 |
| D-2223 | 24.63 | −62.30 | 3.32 | −5.52 |
| D-2225 | −6.63 | −42.35 | −9.38 | −21.15 |
| D-2226 | −38.62 | −62.87 | 10.46 | −8.69 |
| D-2227 | −23.94 | −50.40 | 9.29 | 10.89 |
| D-2228 | 20.09 | −29.75 | 14.14 | 0.05 |
| D-2229 | −18.06 | −31.06 | 11.10 | −14.24 |
| D-2231 | 9.00 | −61.35 | −13.34 | −22.09 |
| D-2232 | 14.77 | −76.09 | 17.15 | −3.37 |
| D-2233 | 7.21 | 8.78 | 0.17 | −10.36 |
| D-2234 | 1.28 | −72.80 | 15.23 | −43.35 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2235 | −37.16 | −74.11 | 20.67 | 2.73 |
| D-2237 | −8.85 | −51.03 | 0.25 | −19.94 |
| D-2239 | −27.30 | −73.35 | 0.97 | −14.70 |
| D-2240 | −27.96 | −75.24 | −4.46 | −17.10 |
| D-2241 | 11.91 | −72.70 | 20.45 | 3.61 |
| D-2242 | −0.33 | −35.08 | 14.34 | 7.58 |
| D-2243 | −36.81 | −74.89 | 4.31 | −11.89 |
| D-2244 | 30.62 | 38.57 | 13.86 | 4.28 |
| D-2245 | −18.07 | −41.66 | 7.87 | −9.64 |
| D-2246 | 6.14 | 56.28 | 29.46 | 28.50 |
| D-2247 | −25.60 | −73.58 | −4.44 | −16.28 |
| D-2248 | 11.51 | −20.86 | 2.87 | −9.83 |
| D-2249 | −16.91 | −39.16 | 0.34 | −14.24 |
| D-2250 | 15.77 | −73.36 | 10.48 | −8.70 |
| D-2251 | 0.43 | −79.99 | 10.74 | −17.83 |
| D-2252 | 6.05 | −65.41 | 5.15 | −14.74 |
| D-2253 | 11.10 | −54.80 | 38.74 | 15.88 |
| D-2254 | 22.21 | −14.24 | 10.79 | −10.26 |
| D-2255 | 41.07 | 18.44 | 6.97 | −2.34 |
| D-2256 | −8.23 | −46.19 | 2.59 | 3.33 |
| D-2257 | −6.65 | −9.03 | −2.27 | −7.54 |
| D-2258 | −7.71 | −76.29 | 5.44 | −7.30 |
| D-2259 | 14.95 | 68.74 | −17.68 | −12.68 |
| D-2260 | 9.67 | −20.49 | 0.97 | 4.43 |
| D-2261 | −24.00 | −45.64 | 13.13 | −0.23 |
| D-2262 | −10.92 | −17.68 | 17.57 | −0.15 |
| D-2263 | 3.34 | −74.25 | 4.98 | −19.68 |
| D-2264 | −8.47 | −74.97 | 8.13 | −7.51 |
| D-2265 | −11.80 | −58.43 | 28.74 | 27.99 |
| D-2268 | −4.67 | −42.18 | −9.56 | −9.46 |
| D-2269 | −8.42 | −50.28 | 5.98 | −6.48 |
| D-2270 | 8.82 | −56.73 | −3.81 | −31.28 |
| D-2271 | −15.05 | −41.32 | 12.61 | 5.63 |
| D-2272 | −2.18 | −51.38 | −13.44 | −20.07 |
| D-2273 | 0.87 | 7.40 | 2.43 | −10.08 |
| D-2274 | 6.84 | −68.97 | 7.29 | −31.31 |
| D-2275 | 17.04 | −20.30 | 4.20 | −17.23 |
| D-2276 | −19.08 | −59.63 | 8.45 | −16.02 |
| D-2277 | −5.23 | −9.32 | 10.54 | 8.24 |
| D-2278 | 16.94 | −47.09 | 5.58 | −2.28 |
| D-2279 | 10.98 | −57.75 | 3.98 | −13.27 |
| D-2280 | 10.99 | 0.50 | 17.83 | 8.21 |
| D-2281 | 3.78 | −7.60 | 7.76 | −7.03 |
| D-2282 | −37.16 | −66.11 | 12.47 | −6.97 |
| D-2283 | −8.81 | −13.66 | 17.66 | −1.44 |
| D-2284 | −6.53 | −56.80 | 18.51 | 1.11 |
| D-2285 | 9.68 | −18.56 | 3.96 | −9.57 |
| D-2286 | −16.88 | −62.09 | 15.77 | −11.21 |
| D-2287 | −7.59 | −35.92 | 9.08 | −6.25 |
| D-2288 | 4.20 | −68.32 | −11.91 | −18.58 |
| D-2289 | 5.56 | −52.09 | 17.51 | 4.86 |
| D-2290 | 47.89 | 3.79 | 15.98 | −2.50 |
| D-2291 | 4.59 | −58.65 | −8.12 | −6.02 |
| D-2292 | 5.27 | −66.33 | −4.90 | −20.75 |
| D-2293 | 16.75 | −52.01 | 21.10 | 6.47 |
| D-2295 | 38.62 | 12.59 | −12.72 | −10.00 |
| D-2297 | 10.83 | 15.03 | 2.26 | 6.34 |
| D-2298 | −4.69 | −2.09 | −2.32 | −13.00 |
| D-2299 | −32.86 | −69.77 | 4.05 | −13.11 |
| D-2302 | 26.26 | −51.02 | 7.13 | 4.49 |
| D-2303 | 11.28 | −45.64 | −3.77 | −19.21 |
| D-2305 | 17.40 | −23.21 | 0.41 | −10.26 |
| D-2306 | 22.94 | −53.98 | 10.63 | −13.70 |
| D-2307 | 19.46 | −39.96 | −1.46 | −13.70 |
| D-2308 | 9.36 | −64.54 | 7.53 | −13.04 |
| D-2309 | 14.37 | −72.06 | 6.47 | −19.58 |
| D-2310 | 24.72 | −29.06 | 8.38 | −9.31 |
| D-2311 | −11.17 | −39.70 | 8.91 | 9.42 |
| D-2312 | 19.21 | −71.67 | 12.28 | −11.47 |
| D-2313 | 19.65 | −21.49 | 3.15 | −11.19 |
| D-2314 | 26.15 | −33.61 | 14.56 | −7.81 |
| D-2315 | −13.03 | −53.10 | 10.65 | −9.69 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2316 | 2.42 | −29.40 | 10.91 | −11.39 |
| D-2317 | −24.49 | −67.65 | 8.33 | −5.38 |
| D-2318 | 9.72 | −40.13 | 8.70 | −3.99 |
| D-2319 | 23.72 | −77.03 | 5.51 | −63.69 |
| D-2320 | 25.70 | 8.69 | 8.27 | −0.77 |
| D-2321 | 8.13 | −69.42 | −17.95 | −37.39 |
| D-2323 | 28.07 | 2.72 | 20.42 | 3.41 |
| D-2324 | 2.89 | −56.23 | 12.76 | −8.95 |
| D-2325 | 13.50 | −77.16 | −4.23 | −14.43 |
| D-2326 | −3.05 | −59.64 | 21.16 | −9.55 |
| D-2327 | −12.00 | −46.84 | 6.14 | −3.12 |
| D-2328 | 6.84 | −40.50 | 10.62 | 8.44 |
| D-2329 | 1.31 | −9.41 | 7.72 | −7.80 |
| D-2330 | 4.59 | −69.60 | 10.79 | −8.67 |
| D-2331 | −9.54 | −73.22 | −9.79 | −29.41 |
| D-2332 | −6.55 | −72.41 | 8.51 | −6.94 |
| D-2333 | 11.17 | −2.82 | 15.48 | 11.15 |
| D-2334 | −2.66 | −75.33 | 12.72 | −9.84 |
| D-2335 | −23.27 | −67.78 | 10.62 | 2.39 |
| D-2336 | −11.80 | 40.65 | −1.01 | −6.78 |
| D-2337 | −15.32 | −76.42 | −2.59 | −32.42 |
| D-2338 | 15.49 | −74.04 | 21.13 | −1.29 |
| D-2339 | 20.66 | 15.26 | −14.02 | −26.53 |
| D-2340 | 26.04 | −1.14 | 7.03 | 4.64 |
| D-2341 | −7.40 | −74.83 | 20.50 | 3.23 |
| D-2342 | −15.34 | −55.08 | 4.90 | −10.82 |
| D-2343 | −12.29 | −46.10 | −10.21 | −20.14 |
| D-2344 | −23.43 | −48.16 | 4.54 | 5.25 |
| D-2345 | −33.71 | −27.73 | −9.81 | −24.68 |
| D-2346 | 6.88 | 13.79 | 2.68 | −10.88 |
| D-2347 | −18.07 | −43.48 | 20.00 | 28.83 |
| D-2348 | −47.43 | −50.28 | −6.14 | −19.13 |
| D-2349 | −5.71 | −72.76 | 0.40 | −30.56 |
| D-2350 | −2.48 | −3.02 | 11.13 | 12.54 |
| D-2351 | 20.23 | −0.55 | 14.59 | 16.95 |
| D-2352 | −26.04 | −79.85 | 2.83 | −41.79 |
| D-2353 | −26.97 | −3.97 | 11.30 | −9.21 |
| D-2355 | 13.01 | −62.85 | 7.05 | −10.93 |
| D-2356 | 22.02 | −42.24 | 4.27 | −3.90 |
| D-2357 | 24.78 | −73.44 | −0.32 | −16.90 |
| D-2358 | 28.79 | −18.62 | 1.16 | −9.13 |
| D-2359 | 16.26 | −75.14 | 0.89 | −50.36 |
| D-2361 | 42.98 | −75.85 | 2.67 | −15.94 |
| D-2363 | 8.25 | −40.20 | −1.94 | −1.25 |
| D-2364 | 11.83 | −29.04 | 14.99 | 7.35 |
| D-2365 | 39.82 | −71.52 | 27.63 | −14.32 |
| D-2366 | 15.79 | 17.44 | 3.57 | −1.02 |
| D-2367 | −34.63 | −60.76 | 6.17 | −13.96 |
| D-2368 | −10.37 | −68.39 | 18.24 | −21.70 |
| D-2369 | −12.78 | −49.28 | 5.09 | −0.64 |
| D-2370 | 0.19 | −52.13 | −14.96 | −30.52 |
| D-2371 | −21.17 | −76.37 | −5.27 | −26.92 |
| D-2372 | −22.46 | −77.36 | 12.13 | −17.20 |
| D-2373 | 25.98 | −27.45 | 11.37 | −10.77 |
| D-2375 | 6.51 | −70.26 | 9.54 | −30.77 |
| D-2376 | −18.34 | −34.30 | 7.94 | 2.16 |
| D-2377 | −0.05 | −19.93 | 11.29 | −7.45 |
| D-2378 | −8.76 | −55.07 | 0.08 | −17.21 |
| D-2379 | −42.39 | −67.16 | −1.86 | −19.30 |
| D-2380 | 9.85 | −50.55 | 6.24 | −15.88 |
| D-2381 | −18.14 | −72.98 | 28.13 | 10.21 |
| D-2382 | 7.36 | −26.01 | 13.66 | 10.26 |
| D-2383 | −39.36 | −62.24 | 18.58 | 13.73 |
| D-2384 | −12.59 | −56.52 | 14.75 | 9.42 |
| D-2385 | −10.79 | 48.93 | 1.58 | −5.69 |
| D-2386 | 46.35 | −44.45 | −5.59 | −14.76 |
| D-2387 | −15.88 | −46.20 | 2.10 | −19.49 |
| D-2389 | 13.76 | −78.69 | −3.01 | −28.91 |
| D-2390 | 9.10 | −30.45 | 17.67 | 2.11 |
| D-2391 | 12.29 | −56.75 | 4.93 | −21.32 |
| D-2392 | −23.49 | −74.83 | 5.02 | −33.62 |
| D-2393 | 16.84 | 3.98 | 14.39 | 1.42 |

TABLE 4-continued

In vitro efficacy of Tier 2 ASGRI siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2394 | −2.71 | −70.98 | 13.26 | −11.62 |
| D-2395 | 7.89 | −27.03 | 4.65 | 2.79 |
| D-2396 | 16.82 | −16.14 | 16.91 | −3.49 |
| D-2397 | 2.12 | −35.82 | 3.89 | −3.96 |
| D-2398 | 9.57 | −41.40 | 18.96 | −0.05 |
| D-2399 | −47.71 | −61.72 | 28.20 | 0.37 |
| D-2400 | −8.35 | −72.99 | 17.07 | −18.54 |
| D-2401 | −28.01 | −75.77 | 1.16 | −14.75 |
| D-2402 | −33.04 | −76.71 | 18.09 | −77.25 |
| D-2404 | −7.61 | −67.29 | −1.09 | −41.79 |
| D-2405 | 0.05 | −17.64 | 3.00 | −0.09 |
| D-2406 | −9.58 | −33.64 | −10.59 | −25.33 |
| D-2407 | −9.63 | −62.24 | −0.08 | −13.96 |
| D-2408 | 14.42 | −3.00 | −6.79 | −16.32 |
| D-2409 | 27.04 | −34.28 | −4.73 | −20.25 |
| D-2410 | −18.30 | −67.46 | 16.81 | −7.29 |
| D-2411 | −21.28 | −57.25 | 12.72 | −8.07 |
| D-2413 | 4.95 | −60.16 | 10.46 | −0.22 |
| D-2414 | −17.33 | −64.07 | −14.55 | −6.78 |
| D-2415 | −15.05 | −65.69 | −9.46 | −17.88 |
| D-2416 | −0.99 | −75.16 | 11.26 | −3.94 |
| D-2417 | 3.05 | −76.41 | −0.91 | −33.96 |
| D-2418 | 1.93 | −24.85 | 29.04 | 17.48 |
| D-2419 | −24.40 | 47.12 | 4.18 | −3.30 |
| D-2420 | 16.06 | −58.83 | 4.35 | −25.40 |
| D-2421 | 1.37 | −74.32 | 9.56 | −21.07 |
| D-2422 | −38.14 | −48.49 | −11.91 | −24.13 |
| D-2423 | −20.41 | −60.80 | −0.41 | −9.66 |
| D-2424 | −48.40 | −65.04 | 2.10 | −8.61 |
| D-2425 | 28.94 | 15.14 | 14.20 | 6.12 |
| D-2426 | 7.89 | −47.66 | 16.10 | 2.93 |
| D-2427 | −19.09 | −23.01 | 1.62 | −3.94 |
| D-2428 | 5.56 | −11.55 | 11.62 | −5.34 |
| D-2429 | 0.52 | −33.21 | −11.43 | −24.16 |
| D-2430 | 4.41 | −37.30 | −3.55 | −16.45 |
| D-2431 | −37.67 | −67.95 | −1.54 | −9.79 |
| D-2432 | −25.32 | −68.85 | −4.13 | −20.36 |
| D-2433 | 0.52 | −71.18 | −7.86 | −31.49 |
| D-2434 | 10.40 | −37.19 | 10.54 | −13.54 |
| D-2435 | 4.86 | −57.38 | 17.34 | 20.49 |
| D-2436 | 18.88 | −35.44 | 23.12 | −12.39 |
| D-2437 | 25.79 | −40.05 | 15.35 | 1.03 |
| D-2438 | 15.05 | 9.99 | 6.80 | −9.53 |
| D-2439 | 21.63 | −41.11 | 18.17 | 2.50 |
| D-2440 | 37.57 | −0.17 | 2.20 | −12.17 |
| D-2441 | −8.06 | −54.57 | 13.61 | 7.61 |
| D-2442 | 36.79 | 57.61 | 5.61 | −6.44 |
| D-2443 | 11.36 | −66.78 | 2.92 | −13.62 |
| D-2444 | −38.81 | −72.85 | 8.54 | −3.71 |
| D-2445 | −11.04 | −64.66 | 8.08 | −2.29 |
| D-2446 | 3.82 | −42.52 | −10.45 | −14.16 |
| D-2447 | −7.91 | −58.98 | 13.44 | −4.86 |
| D-2448 | 7.34 | −12.66 | 4.65 | −11.66 |
| D-2449 | −31.64 | −2.57 | −7.05 | −21.21 |
| D-2450 | −18.81 | −37.87 | −0.24 | −4.80 |
| D-2451 | −9.05 | −65.54 | 8.96 | −5.60 |
| D-2452 | 7.97 | −72.48 | −5.11 | −13.04 |
| D-2453 | −4.77 | −45.85 | 12.38 | −13.76 |
| D-2454 | 21.10 | −54.04 | 4.37 | −13.62 |
| D-2455 | 8.18 | −71.54 | 5.31 | −22.07 |
| D-2456 | 11.23 | −30.35 | −2.67 | −15.16 |
| D-2457 | 5.60 | −60.92 | 1.84 | −1.91 |
| D-2458 | 21.64 | −76.04 | 4.05 | −4.69 |
| D-2459 | 32.73 | −39.55 | 12.68 | 2.47 |
| D-2460 | −13.78 | −51.39 | 10.57 | 11.22 |
| D-2461 | −18.30 | −80.09 | −13.02 | −48.39 |
| D-2463 | −24.85 | −9.05 | 6.56 | −10.92 |
| D-2464 | 8.42 | −30.80 | 13.50 | −8.82 |
| D-2467 | −8.91 | −35.24 | −1.05 | −16.07 |
| D-2469 | 9.90 | −74.91 | 12.09 | −2.50 |
| D-2470 | −16.83 | −18.78 | 9.64 | 4.78 |
| D-2471 | −13.11 | −39.34 | 17.59 | −0.33 |
| D-2472 | −51.91 | −74.29 | 0.08 | −22.90 |
| D-2473 | −23.85 | −64.30 | 4.48 | −3.65 |
| D-2474 | −18.97 | −73.74 | −9.30 | −20.23 |
| D-2476 | −12.39 | −39.15 | −5.50 | −14.58 |
| D-2477 | −36.35 | −71.63 | −9.00 | −8.89 |
| D-2478 | 5.73 | −71.48 | −7.35 | −21.50 |
| D-2479 | 29.53 | −66.03 | 6.47 | −17.15 |
| D-2480 | 13.11 | −73.36 | 1.49 | −45.78 |
| D-2482 | −1.37 | −14.22 | 26.88 | 7.58 |
| D-2483 | −26.46 | −76.11 | 9.13 | −15.10 |
| D-2484 | −7.16 | −76.11 | 14.31 | −8.27 |
| D-2485 | −6.97 | −64.92 | −0.65 | 2.47 |
| D-2486 | −38.05 | −65.90 | 10.21 | −3.14 |
| D-2488 | 4.40 | −65.48 | 23.24 | −1.45 |
| D-2489 | 10.61 | −50.59 | 2.76 | −16.97 |
| D-2490 | −6.92 | −56.48 | 13.36 | −5.04 |
| D-2491 | −28.11 | −69.71 | 10.95 | −11.63 |
| D-2492 | 4.59 | 34.94 | 21.34 | −5.76 |
| D-2493 | 9.43 | −74.40 | 19.78 | −3.04 |
| D-2494 | −8.07 | −59.67 | −2.85 | −15.61 |
| D-2495 | 0.92 | −8.01 | 22.82 | 8.68 |
| D-2496 | 23.04 | −8.86 | 14.79 | 2.59 |
| D-2497 | 6.97 | −9.77 | −5.74 | −17.82 |
| D-2498 | −0.92 | −30.75 | 5.10 | −9.22 |
| D-2499 | 3.63 | −39.99 | 12.48 | −5.26 |
| D-2500 | −0.48 | 13.29 | 22.96 | 11.73 |
| D-2501 | −7.36 | −19.71 | −3.48 | −6.31 |
| D-2502 | −17.21 | −41.54 | 16.86 | −1.63 |

The results from the screening assay of the Tier 2 molecules revealed an additional 663 potent siRNA molecules that reduced ASGR1 cell surface expression relative to control cells by at least 50% when tested at 5 nM. These siRNA molecules were not included in Tier 1 and were not identified from the bioinformatics analysis of the transcript sequences. At least 263 of these new siRNA molecules reduced ASGR1 cell surface expression relative to control cells by at least 70% and at least 14 siRNA molecules reduced ASGR1 cell surface expression relative to control cells by at least 80% when tested at 5 nM.

Example 3. Efficacy of Select ASGR1 siRNA molecules in RNA FISH Assay

To assess the potency of a subgroup of ASGR1 siRNA molecules in reducing ASGR1 expression at the mRNA level, IC50 values were determined for each siRNA in an ASGR1 RNA Fluorescence In Situ Hybridization (FISH) assay. Hep3B cells (ATCC HB-8064) were transfected with siRNA using Lipofectamine RNAiMAX transfection reagent (ThermoFisher Scientific 13378-150), at 0.035 μL/reaction. Human ASGR1 siRNAs were tested in a 10 point dose response format, 3-fold dilutions, ranging from 0-83.3 nM, final concentration. Control siRNAs were tested at 5 nM, final concentration and included: a Neutral Control (used for normalization): Non-Targeting RcsC2 (UUA-CAUCGUUAAUGCGUUA (SEQ ID NO: 4316), an Inhibitor Positive Control: human ASGR1 (ACUU-CACAGCGAGCACGGA (SEQ ID NO: 4317), and a Transfection Control: human EIF4A3 (GCAUCUUG-GUGAAACGUGA (SEQ ID NO: 4318). Cells were seeded over the transfection complex at 2000 cells per reaction in Perkin Elmer Cell Carrier PDL-coated 384 well assay plates (Perkin Elmer #6007580). The transfection period was 96 hours, after which cells were fixed with 4% methanol free formaldehyde, final concentration. Directly post fixation, cells were dehydrated in ethanol following the Dehydrating Cells for Storage or Shipping protocol within the manufacturer's protocol for the Affymetrix QuantiGene View RNA HC Screening Assay. Plates were sealed and stored at −20° C.

According to the manufacturer's protocol, cells were rehydrated and processed in the Affymetrix QuantiGene View RNA HC Screening Assay, an in situ hybridization method to quantify messenger RNA levels. In this instance, the multiplex assay detected human ASGR1 (NM_001671.4; SEQ ID NO: 1), human ASGR2 (NM_0080912.3 or NM_001181.4), and human PPIB (NM_000942.4). The assay was carried out using the QG ViewRNA HC Screening Assay Kit and the QG ViewRNA HC Screening Signal Amp Kit, 3-plex (Affymetrix QVP0011 and QVP0213, respectively) and probe sets for the detection of human ASGR1, ASGR2 and PPIB (Affymetrix, VA6-19401-01, custom type 4 probe, VA1-10148-01 respectively). Each probe set is labeled with a different fluorophore. Protease for the digestion step was added at 1:8000, final concentration. Post assay, nuclei and cytoplasm were counterstained using Hoechst 33342 nuclear stain and Cell Mask Blue reagents (ThermoFisher Scientific H3570 and H32720 at final concentrations of 10 ng/μL and 4 ng/μL, respectively). Plate was imaged on the Perkin Elmer Phenix reading Hoechst and Cell Mask Blue in the UV channel, PPIB/Type1 in the 488 channel, ASGR2/Type4 in the 550 channel and ASGR1/Type6 in the 650 channel. Image acquisition and data analysis was completed in the Perkin Elmer Columbus software package and well normalization/IC50 value generation was completed in Genedata Screener.

The results of the assay are shown in Table 5. The IC50 values determined in the RNA FISH assay correlate with those determined in the immunoassay for ASGR1 protein levels described in Example 2. However, at the time points tested, the IC50 values determined in the RNA FISH assay are higher than those determined in the immunoassay.

TABLE 5

IC50 values determined by RNA FISH assay for select ASGRI siRNA molecules

| Duplex No. | IC50 (nM) |
|---|---|
| D-1168 | >83.33 |
| D-1170 | 0.62 |
| D-1171 | 1.74 |
| D-1173 | 1.65 |
| D-1176 | 5.12 |
| D-1206 | 4.70 |
| D-1235 | 1.57 |
| D-1389 | 0.68 |
| D-1397 | 1.06 |
| D-1408 | >83.33 |
| D-1443 | 0.58 |
| D-1497 | 3.65 |
| D-1708 | 0.05 |
| D-1815 | 1.18 |
| D-1826 | 3.47 |
| D-1981 | 1.81 |
| D-1989 | 2.07 |
| D-1999 | 0.27 |
| D-2000 | 7.04 |
| D-2142 | 9.26 |
| D-2143 | 4.42 |
| D-2357 | 0.40 |
| D-2361 | 1.42 |
| D-2401 | 1.73 |
| D-2461 | 4.03 |

Example 4. Design and Synthesis of Modified ASGR1 siRNA Molecules

To improve the potency and in vivo stability of the ASGR1 siRNA molecules, chemical modifications were incorporated into a subset of the most potent ASGR1 siRNA molecules from the Tier 1 and Tier 2 screens, including five of the most potent ASGR1 siRNA molecules from the Tier1 screen that also had sequence homology with mouse Asgr1 mRNA and cynomolgus monkey ASGR1 mRNA. Specifically, 2'-O-methyl and 2'-fluoro modifications of the ribose sugar were incorporated at specific positions within the ASGR1 siRNAs. Phosphorothioate internucleotide linkages were also incorporated at the terminal ends of the antisense and/or sense sequences. Table 6 below depicts the modifications in the sense and antisense sequences for each of the modified ASGR1 siRNAs. The nucleotide sequences in Table 6 are listed according to the following notations: A, U, G, and C=corresponding ribonucleotide; dT=deoxythymidine; a, u, g, and c=corresponding 2'-O-methyl ribonucleotide; Af, Uf, Gf, and Cf=corresponding 2'-deoxy-2'-fluoro ("2'-fluoro") ribonucleotide. Insertion of an "s" in the sequence indicates that the two adjacent nucleotides are connected by a phosphorothiodiester group (e.g. a phosphorothioate internucleotide linkage). Unless indicated otherwise, all other nucleotides are connected by 3'-5' phosphodiester groups. Each of the siRNA compounds in Table 6 comprises a 19 base pair duplex region with a 2 nucleotide overhang at the 3' end of both strands.

TABLE 6

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3000 | AGGcccuAccGcuGGGucudTsdT | 3014 | AGACCcAGCGGuAGGGCCUdTsdT | 3665 |
| D-3001 | AfgGfcCfcUfAfCfCfGfcUfgGfgUfcUfuUf | 3015 | aGfaCfcCfaGfcgguaGfgGfcCfusUfsu | 3666 |
| D-3002 | AfgGfcCfcUfAfcCfGfcUfgGfgUfcUfuUf | 3016 | aGfaCfcCfaGfcgGfuaGfgGfcCfusUfsu | 3667 |
| D-3003 | AfgGfcCfcUfacCfGfcUfgGfgUfcUfuUf | 3017 | aGfaCfcCfaGfcgGfUfaGfgGfcCfusUfsu | 3668 |
| D-3004 | AfgGfcCfcUfaCfCfGfCfUfgGfgUfcUfuUf | 3018 | aGfaCfcCfagcggUfaGfgGfcCfusUfsu | 3669 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3005 | AfgGfcCfcUfaCfCfgCfUfgGfgUfcUfuUf | 3019 | aGfaCfcCfagCfggUfaGfgGfcCfusUfsu | 3670 |
| D-3006 | AfgGfcCfcUfaCfCfgcUfgGfgUfcUfuUf | 3020 | aGfaCfcCfaGfCfggUfaGfgGfcCfusUfsu | 3671 |
| D-3007 | AfgGfcCfcuAfCfcGfcUfgGfgUfcUfuUf | 3021 | aGfaCfcCfaGfcGfguAfGfgGfcCfusUfsu | 3672 |
| D-3008 | AfgGfcCfcUfaCfcGfCfugGfgUfcUfuUf | 3022 | aGfaCfcCfAfgcGfgUfaGfgGfcCfusUfsu | 3673 |
| D-3009 | AfsgsGfcCfcuAfCfcGfcUfgGfgUfcUfuUf | 3023 | asGfsaCfcCfaGfcGfguAfGfgGfcCfusUfsu | 3674 |
| D-3010 | AfgGfcCfcuAfCfcGfcUfgGfgUfcUfuUf | 3024 | aGfaCfcCfaGfcGfguAfGfgGfcCfuUfu | 3675 |
| D-3011 | AfsgsGfcCfcUfaCfcGfCfugGfgUfcUfuUf | 3025 | asGfsaCfcCfAfgcGfgUfaGfgGfcCfusUfsu | 3676 |
| D-3012 | AfgGfcCfcUfaCfcGfCfugGfgUfcUfuUf | 3026 | aGfaCfcCfAfgcGfgUfaGfgGfcCfuUfu | 3677 |
| D-3013 | AfgGfcCfCfuaCfcGfcUfgGfgUfcUfuUf | 3027 | aGfaCfcCfaGfcGfgUfAfggGfcCfusUfsu | 3678 |
| D-3014 | AfgGfccCfUfaCfcGfcUfgGfgUfcUfuUf | 3028 | aGfaCfcCfaGfcGfgUfagGfGfcCfusUfsu | 3679 |
| D-3015 | AfgGfCfccUfaCfcGfcUfgGfgUfcUfuUf | 3029 | aGfaCfcCfaGfcGfgUfaGfGfgcCfusUfsu | 3680 |
| D-3016 | AfggCfCfcUfaCfcGfcUfgGfgUfcUfuUf | 3030 | aGfaCfcCfaGfcGfgUfaGfggCfCfusUfsu | 3681 |
| D-3017 | AfGfgcCfcUfaCfcGfcUfgGfgUfcUfuUf | 3031 | aGfaCfcCfaGfcGfgUfaGfgGfCfcusUfsu | 3682 |
| D-3018 | aGfGfcCfcUfaCfcGfcUfgGfgUfcUfuUf | 3032 | aGfaCfcCfaGfcGfgUfaGfgGfccUfsUfsu | 3683 |
| D-3019 | agGfcCfcUfaCfcGfcUfgGfgUfcUfuUf | 3033 | aGfaCfcCfaGfcGfgUfaGfgGfcCfUfsusu | 3684 |
| D-3020 | AfgGfcCfcUfaCfcGfcuGfGfgUfcUfuUf | 3034 | aGfaCfccAfGfcGfgUfaGfgGfcCfusUfsu | 3685 |
| D-3021 | AfgGfcCfcUfaCfcGfcUfGfggUfcUfuUf | 3035 | aGfaCfCfcaGfcGfgUfaGfgGfcCfusUfsu | 3686 |
| D-3022 | AfgGfcCfcUfaCfcGfcUfggGfUfcUfuUf | 3036 | aGfacCfCfaGfcGfgUfaGfgGfcCfusUfsu | 3687 |
| D-3023 | AfgGfcCfcUfaCfcGfcUfgGfGfucUfuUf | 3037 | aGfAfccCfaGfcGfgUfaGfgGfcCfusUfsu | 3688 |
| D-3024 | AfgGfcCfcUfaCfcGfcUfgGfguCfUfuUf | 3038 | agAfCfcCfaGfcGfgUfaGfgGfcCfusUfsu | 3689 |
| D-3025 | AfgGfcCfcUfaCfcGfcUfgGfgUfCfuuUf | 3039 | AfgaCfcCfaGfcGfgUfaGfgGfcCfusUfsu | 3690 |
| D-3026 | AfgGfcCfcUfaCfcGfcUfgGfgUfcuUfUf | 3040 | AfGfaCfcCfaGfcGfgUfaGfgGfcCfusUfsu | 3691 |
| D-3027 | AfGfgcCfCfuaCfCfgcUfGfggUfCfuuUf | 3041 | AfgaCfCfcaGfCfggUfAfggGfCfcusUfsUf | 3692 |
| D-3028 | agGfCfccUfAfccGfCfugGfGfucUfUfu | 3042 | aGfAfccCfAfgcGfGfuaGfGfgcCfUfsusu | 3693 |
| D-3029 | AfggCfCfcuAfCfcgCfUfggGfUfcuUfUf | 3043 | AfGfacCfCfagCfGfguAfGfggCfCfususUf | 3694 |
| D-3030 | aGfGfccCfUfacCfGfcuGfGfguCfUfuu | 3044 | agAfCfccAfGfcgGfUfagGfGfccUfsUfsu | 3695 |
| D-3031 | GuGGGAAGAAAGAuGAAGudTsdT | 3045 | ACUUcAUCUUUCUUCCcACdTsdT | 3696 |
| D-3032 | GfuGfgGfaAfGfAfAfAfgAfuGfaAfgUfuUf | 3046 | aCfuUfcAfuCfuuucuUfcCfcAfcsUfsu | 3697 |
| D-3033 | GfuGfgGfaAfGfaAfAfgAfuGfaAfgUfuUf | 3047 | aCfuUfcAfuCfuuUfcuUfcCfcAfcsUfsu | 3698 |
| D-3034 | GfuGfgGfaAfgaAfAfgAfuGfaAfgUfuUf | 3048 | aCfuUfcAfuCfuuUfCfuUfcCfcAfcsUfsu | 3699 |
| D-3035 | GfuGfgGfaAfgAfAfAfGfAfuGfaAfgUfuUf | 3049 | aCfuUfcAfucuuuCfuUfcCfcAfcsUfsu | 3700 |
| D-3036 | GfuGfgGfaAfgAfAfaGfAfuGfaAfgUfuUf | 3050 | aCfuUfcAfucUfuuCfuUfcCfcAfcsUfsu | 3701 |
| D-3037 | GfuGfgGfaAfgAfAfagAfuGfaAfgUfuUf | 3051 | aCfuUfcAfuCfUfuuCfuUfcCfcAfcsUfsu | 3702 |
| D-3038 | GfuGfgGfaaGfAfaAfgAfuGfaAfgUfuUf | 3052 | aCfuUfcAfuCfuUfucUfUfcCfcAfcsUfsu | 3703 |
| D-3039 | GfuGfgGfaAfgAfaAfGfauGfaAfgUfuUf | 3053 | aCfuUfcAfUfcuUfuCfuUfcCfcAfcsUfsu | 3704 |
| D-3040 | GfsusGfgGfaaGfAfaAfgAfuGfaAfgUfuUf | 3054 | asCfsuUfcAfuCfuUfucUfUfcCfcAfcsUfsu | 3705 |
| D-3041 | GfuGfgGfaaGfAfaAfgAfuGfaAfgUfuUf | 3055 | aCfuUfcAfuCfuUfucUfUfcCfcAfcUfu | 3706 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3042 | GfsusGfgGfaAfgAfaAfGfauGfaAfgUfuUf | 3056 | asCfsuUfcAfUfcuUfuCfuUfcCfcAfcsUfsu | 3707 |
| D-3043 | GfuGfgGfaAfgAfaAfGfauGfaAfgUfuUf | 3057 | aCfuUfcAfUfcuUfuCfuUfcCfcAfcUfu | 3708 |
| D-3044 | GfuGfgGfAfagAfaAfgAfuGfaAfgUfuUf | 3058 | aCfuUfcAfuCfuUfuCfUfucCfcAfcsUfsu | 3709 |
| D-3045 | GfuGfggAfAfgAfaAfgAfuGfaAfgUfuUf | 3059 | aCfuUfcAfuCfuUfuCfuuCfCfcAfcsUfsu | 3710 |
| D-3046 | GfuGfGfgaAfgAfaAfgAfuGfaAfgUfuUf | 3060 | aCfuUfcAfuCfuUfuCfuUfCfccAfcsUfsu | 3711 |
| D-3047 | GfugGfGfaAfgAfaAfgAfuGfaAfgUfuUf | 3061 | aCfuUfcAfuCfuUfuCfuUfccCfAfcsUfsu | 3712 |
| D-3048 | GfUfggGfaAfgAfaAfgAfuGfaAfgUfuUf | 3062 | aCfuUfcAfuCfuUfuCfuUfcCfCfacsUfsu | 3713 |
| D-3049 | gUfGfgGfaAfgAfaAfgAfuGfaAfgUfuUf | 3063 | aCfuUfcAfuCfuUfuCfuUfcCfcaCfsUfsu | 3714 |
| D-3050 | guGfgGfaAfgAfaAfgAfuGfaAfgUfuUf | 3064 | aCfuUfcAfuCfuUfuCfuUfcCfcAfCfsusu | 3715 |
| D-3051 | GfuGfgGfaAfgAfaAfgaUfGfaAfgUfuUf | 3065 | aCfuUfcaUfCfuUfuCfuUfcCfcAfcsUfsu | 3716 |
| D-3052 | GfuGfgGfaAfgAfaAfgAfUfgaAfgUfuUf | 3066 | aCfuUfCfauCfuUfuCfuUfcCfcAfcsUfsu | 3717 |
| D-3053 | GfuGfgGfaAfgAfaAfgAfugAfAfgUfuUf | 3067 | aCfuuCfAfuCfuUfuCfuUfcCfcAfcsUfsu | 3718 |
| D-3054 | GfuGfgGfaAfgAfaAfgAfuGfAfagUfuUf | 3068 | aCfUfucAfuCfuUfuCfuUfcCfcAfcsUfsu | 3719 |
| D-3055 | GfuGfgGfaAfgAfaAfgAfuGfaaGfUfuUf | 3069 | acUfUfcAfuCfuUfuCfuUfcCfcAfcsUfsu | 3720 |
| D-3056 | GfuGfgGfaAfgAfaAfgAfuGfaAfGfuuUf | 3070 | AfcuUfcAfuCfuUfuCfuUfcCfcAfcsUfsu | 3721 |
| D-3057 | GfuGfgGfaAfgAfaAfgAfuGfaAfguUfUf | 3071 | AfCfuUfcAfuCfuUfuCfuUfcCfcAfcsUfsu | 3722 |
| D-3058 | GfUfggGfAfagAfAfagAfUfgaAfGfuuUf | 3072 | AfcuUfCfauCfUfuuCfUfucCfCfacsUfsUf | 3723 |
| D-3059 | guGfGfgaAfGfaaAfGfauGfAfagUfUfu | 3073 | aCfUfucAfUfcuUfUfcuUfCfccAfCfsusu | 3724 |
| D-3060 | GfugGfGfaaGfAfaaGfAfugAfAfguUfUf | 3074 | AfCfuuCfAfucUfUfucUfUfccCfAfcsusUf | 3725 |
| D-3061 | gUfGfggAfAfgaAfAfgaUfGfaaGfUfuu | 3075 | acUfUfcaUfCfuuUfCfuuCfCfcaCfsUfsu | 3726 |
| D-3062 | GAGAcGGGcuucAAGAAcudTsdT | 3076 | AGUUCUUGAAGCCCGUCUCdTsdT | 3727 |
| D-3063 | GfaGfaCfgGfGfCfUfUfcAfaGfaAfcUfuUf | 3077 | aGfuUfcUfuGfaagccCfgUfcUfcsUfsu | 3728 |
| D-3064 | GfaGfaCfgGfGfcUfUfcAfaGfaAfcUfuUf | 3078 | aGfuUfcUfuGfaaGfccCfgUfcUfcsUfsu | 3729 |
| D-3065 | GfaGfaCfgGfgcUfUfcAfaGfaAfcUfuUf | 3079 | aGfuUfcUfuGfaaGfCfcCfgUfcUfcsUfsu | 3730 |
| D-3066 | GfaGfaCfgGfgCfUfUfCfAfaGfaAfcUfuUf | 3080 | aGfuUfcUfugaagCfcCfgUfcUfcsUfsu | 3731 |
| D-3067 | GfaGfaCfgGfgCfUfuCfAfaGfaAfcUfuUf | 3081 | aGfuUfcUfugAfagCfcCfgUfcUfcsUfsu | 3732 |
| D-3068 | GfaGfaCfgGfgCfUfucAfaGfaAfcUfuUf | 3082 | aGfuUfcUfuGfAfagCfcCfgUfcUfcsUfsu | 3733 |
| D-3069 | GfaGfaCfggGfCfuUfcAfaGfaAfcUfuUf | 3083 | aGfuUfcUfuGfaAfgcCfCfgUfcUfcsUfsu | 3734 |
| D-3070 | GfaGfaCfgGfgCfuUfCfaaGfaAfcUfuUf | 3084 | aGfuUfcUfUfgaAfgCfcCfgUfcUfcsUfsu | 3735 |
| D-3071 | GfsasGfaCfggGfCfuUfcAfaGfaAfcUfuUf | 3085 | asGfsuUfcUfuGfaAfgcCfCfgUfcUfcsUfsu | 3736 |
| D-3072 | GfaGfaCfggGfCfuUfcAfaGfaAfcUfuUf | 3086 | aGfuUfcUfuGfaAfgcCfCfgUfcUfcUfu | 3737 |
| D-3073 | GfsasGfaCfgGfgCfuUfCfaaGfaAfcUfuUf | 3087 | asGfsuUfcUfUfgaAfgCfcCfgUfcUfcsUfsu | 3738 |
| D-3074 | GfaGfaCfgGfgCfuUfCfaaGfaAfcUfuUf | 3088 | aGfuUfcUfUfgaAfgCfcCfgUfcUfcUfu | 3739 |
| D-3075 | GfaGfaCfGfggCfuUfcAfaGfaAfcUfuUf | 3089 | aGfuUfcUfuGfaAfgCfCfcgUfcUfcsUfsu | 3740 |
| D-3076 | GfaGfacGfGfgCfuUfcAfaGfaAfcUfuUf | 3090 | aGfuUfcUfuGfaAfgCfccGfUfcUfcsUfsu | 3741 |
| D-3077 | GfaGfAfcgGfgCfuUfcAfaGfaAfcUfuUf | 3091 | aGfuUfcUfuGfaAfgCfcCfGfucUfcsUfsu | 3742 |
| D-3078 | GfagAfCfgGfgCfuUfcAfaGfaAfcUfuUf | 3092 | aGfuUfcUfuGfaAfgCfcCfguCfUfcsUfsu | 3743 |
| D-3079 | GfAfgaCfgGfgCfuUfcAfaGfaAfcUfuUf | 3093 | aGfuUfcUfuGfaAfgCfcCfgUfCfucsUfsu | 3744 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3080 | gAfGfaCfgGfgCfuUfcAfaGfaAfcUfuUf | 3094 | aGfuUfcUfuGfaAfgCfcCfgUfcuCfsUfsu | 3745 |
| D-3081 | gaGfaCfgGfgCfuUfcAfaGfaAfcUfuUf | 3095 | aGfuUfcUfuGfaAfgCfcCfgUfcUfCfsusu | 3746 |
| D-3082 | GfaGfaCfgGfgCfuUfcaAfGfaAfcUfuUf | 3096 | aGfuUfcuUfGfaAfgCfcCfgUfcUfcsUfsu | 3747 |
| D-3083 | GfaGfaCfgGfgCfuUfcAfAfgaAfcUfuUf | 3097 | aGfuUfCfuuGfaAfgCfcCfgUfcUfcsUfsu | 3748 |
| D-3084 | GfaGfaCfgGfgCfuUfcAfagAfAfcUfuUf | 3098 | aGfuuCfUfuGfaAfgCfcCfgUfcUfcsUfsu | 3749 |
| D-3085 | GfaGfaCfgGfgCfuUfcAfaGfAfacUfuUf | 3099 | aGfUfucUfuGfaAfgCfcCfgUfcUfcsUfsu | 3750 |
| D-3086 | GfaGfaCfgGfgCfuUfcAfaGfaaCfUfuUf | 3100 | agUfUfcUfuGfaAfgCfcCfgUfcUfcsUfsu | 3751 |
| D-3087 | GfaGfaCfgGfgCfuUfcAfaGfaAfCfuuUf | 3101 | AfguUfcUfuGfaAfgCfcCfgUfcUfcsUfsu | 3752 |
| D-3088 | GfaGfaCfgGfgCfuUfcAfaGfaAfcuUfUf | 3102 | AfGfuUfcUfuGfaAfgCfcCfgUfcUfcsUfsu | 3753 |
| D-3089 | GfAfgaCfGfggCfUfucAfAfgaAfCfuuUf | 3103 | AfguUfCfuuGfAfagCfCfcgUfCfucsUfsUf | 3754 |
| D-3090 | gaGfAfcgGfGfcuUfCfaaGfAfacUfUfu | 3104 | aGfUfucUfUfgaAfGfccCfGfucUfCfsusu | 3755 |
| D-3091 | GfagAfCfggGfCfuuCfAfagAfAfcuUfUf | 3105 | AfGfuuCfUfugAfAfgcCfCfguCfUfcsusUf | 3756 |
| D-3092 | gAfGfacGfGfgcUfUfcaAfGfaaCfUfuu | 3106 | agUfUfcuUfGfaaGfCfccGfUfcuCfsUfsu | 3757 |
| D-3093 | GAGcGcAGcuGcuAcuGGudTsdT | 3107 | ACcAGuAGcAGCUGCGCUCdTsdT | 3758 |
| D-3094 | GfaGfcGfcAfGfCfUfGfcUfaCfuGfgUfuUf | 3108 | aCfcAfgUfaGfcagcuGfcGfcUfcsUfsu | 3759 |
| D-3095 | GfaGfcGfcAfGfcUfGfcUfaCfuGfgUfuUf | 3109 | aCfcAfgUfaGfcaGfcuGfcGfcUfcsUfsu | 3760 |
| D-3096 | GfaGfcGfcAfgcUfGfcUfaCfuGfgUfuUf | 3110 | aCfcAfgUfaGfcaGfCfuGfcGfcUfcsUfsu | 3761 |
| D-3097 | GfaGfcGfcAfgCfUfGfCfUfaCfuGfgUfuUf | 3111 | aCfcAfgUfagcagCfuGfcGfcUfcsUfsu | 3762 |
| D-3098 | GfaGfcGfcAfgCfUfgCfUfaCfuGfgUfuUf | 3112 | aCfcAfgUfagCfagCfuGfcGfcUfcsUfsu | 3763 |
| D-3099 | GfaGfcGfcAfgCfUfgcUfaCfuGfgUfuUf | 3113 | aCfcAfgUfaGfCfagCfuGfcGfcUfcsUfsu | 3764 |
| D-3100 | GfaGfcGfcaGfCfuGfcUfaCfuGfgUfuUf | 3114 | aCfcAfgUfaGfcAfgcUfGfcGfcUfcsUfsu | 3765 |
| D-3101 | GfaGfcGfcAfgCfuGfCfuaCfuGfgUfuUf | 3115 | aCfcAfgUfAfgcAfgCfuGfcGfcUfcsUfsu | 3766 |
| D-3102 | GfsasGfcGfcaGfCfuGfcUfaCfuGfgUfuUf | 3116 | asCfscAfgUfaGfcAfgcUfGfcGfcUfcsUfsu | 3767 |
| D-3103 | GfaGfcGfcaGfCfuGfcUfaCfuGfgUfuUf | 3117 | aCfcAfgUfaGfcAfgcUfGfcGfcUfcUfu | 3768 |
| D-3104 | GfsasGfcGfcAfgCfuGfCfuaCfuGfgUfuUf | 3118 | asCfscAfgUfAfgcAfgCfuGfcGfcUfcsUfsu | 3769 |
| D-3105 | GfaGfcGfcAfgCfuGfCfuaCfuGfgUfuUf | 3119 | aCfcAfgUfAfgcAfgCfuGfcGfcUfcUfu | 3770 |
| D-3106 | GfaGfcGfCfagCfuGfcUfaCfuGfgUfuUf | 3120 | aCfcAfgUfaGfcAfgCfUfgcGfcUfcsUfsu | 3771 |
| D-3107 | GfaGfcgCfAfgCfuGfcUfaCfuGfgUfuUf | 3121 | aCfcAfgUfaGfcAfgCfugCfGfcUfcsUfsu | 3772 |
| D-3108 | GfaGfCfgcAfgCfuGfcUfaCfuGfgUfuUf | 3122 | aCfcAfgUfaGfcAfgCfuGfCfgcUfcsUfsu | 3773 |
| D-3109 | GfagCfGfcAfgCfuGfcUfaCfuGfgUfuUf | 3123 | aCfcAfgUfaGfcAfgCfuGfcgCfUfcsUfsu | 3774 |
| D-3110 | GfAfgcGfcAfgCfuGfcUfaCfuGfgUfuUf | 3124 | aCfcAfgUfaGfcAfgCfuGfcGfCfucsUfsu | 3775 |
| D-3111 | gAfGfcGfcAfgCfuGfcUfaCfuGfgUfuUf | 3125 | aCfcAfgUfaGfcAfgCfuGfcGfcuCfsUfsu | 3776 |
| D-3112 | gaGfcGfcAfgCfuGfcUfaCfuGfgUfuUf | 3126 | aCfcAfgUfaGfcAfgCfuGfcGfcUfCfsusu | 3777 |
| D-3113 | GfaGfcGfcAfgCfuGfcuAfCfuGfgUfuUf | 3127 | aCfcAfguAfGfcAfgCfuGfcGfcUfcsUfsu | 3778 |
| D-3114 | GfaGfcGfcAfgCfuGfcUfAfcuGfgUfuUf | 3128 | aCfcAfGfuaGfcAfgCfuGfcGfcUfcsUfsu | 3779 |
| D-3115 | GfaGfcGfcAfgCfuGfcUfacUfGfgUfuUf | 3129 | aCfcaGfUfaGfcAfgCfuGfcGfcUfcsUfsu | 3780 |
| D-3116 | GfaGfcGfcAfgCfuGfcUfaCfUfggUfuUf | 3130 | aCfCfagUfaGfcAfgCfuGfcGfcUfcsUfsu | 3781 |

TABLE 6-continued

| ASGR1 chemically modified siRNA Sequences | | | | |
|---|---|---|---|---|
| Duplex No. | Sense Sequence (5'-3') | SEQ ID NO: (sense) | Antisense Sequence (5'-3') | SEQ ID NO: (antisense) |
| D-3117 | GfaGfcGfcAfgCfuGfcUfaCfugGfUfuUf | 3131 | acCfAfgUfaGfcAfgCfuGfcGfcUfcsUfsu | 3782 |
| D-3118 | GfaGfcGfcAfgCfuGfcUfaCfuGfGfuuUf | 3132 | AfccAfgUfaGfcAfgCfuGfcGfcUfcsUfsu | 3783 |
| D-3119 | GfaGfcGfcAfgCfuGfcUfaCfuGfguUfUf | 3133 | AfCfcAfgUfaGfcAfgCfuGfcGfcUfcsUfsu | 3784 |
| D-3120 | GfAfgcGfCfagCfUfgcUfAfcuGfGfuuUf | 3134 | AfccAfGfuaGfCfagCfUfgcGfCfucsUfsUf | 3785 |
| D-3121 | gaGfCfgcAfGfcuGfCfuaCfUfggUfUfu | 3135 | aCfCfagUfAfgcAfGfcuGfCfgcUfCfsusu | 3786 |
| D-3122 | GfagCfGfcaGfCfugCfUfacUfGfguUfUf | 3136 | AfCfcaGfUfagCfAfgcUfGfcgCfUfcsusUf | 3787 |
| D-3123 | gAfGfcgCfAfgcUfGfcuAfCfugGfUfuu | 3137 | acCfAfguAfGfcaGfCfugCfGfcuCfsUfsu | 3788 |
| D-3124 | GuuGucuGuGuGAucGGAudTsdT | 3138 | AUCCGAUcAcAcAGAcAACdTsdT | 3789 |
| D-3125 | GfuUfgUfcUfGfUfGfUfgAfuCfgGfaUfuUf | 3139 | aUfcCfgAfuCfacacaGfaCfaAfcsUfsu | 3790 |
| D-3126 | GfuUfgUfcUfGfuGfUfgAfuCfgGfaUfuUf | 3140 | aUfcCfgAfuCfacAfcaGfaCfaAfcsUfsu | 3791 |
| D-3127 | GfuUfgUfcUfguGfUfgAfuCfgGfaUfuUf | 3141 | aUfcCfgAfuCfacAfCfaGfaCfaAfcsUfsu | 3792 |
| D-3128 | GfuUfgUfcUfgUfGfUfGfAfuCfgGfaUfuUf | 3142 | aUfcCfgAfucacaCfaGfaCfaAfcsUfsu | 3793 |
| D-3129 | GfuUfgUfcUfgUfGfuGfAfuCfgGfaUfuUf | 3143 | aUfcCfgAfucAfcaCfaGfaCfaAfcsUfsu | 3794 |
| D-3130 | GfuUfgUfcUfgUfGfugAfuCfgGfaUfuUf | 3144 | aUfcCfgAfuCfAfcaCfaGfaCfaAfcsUfsu | 3795 |
| D-3131 | GfuUfgUfcuGfUfgUfgAfuCfgGfaUfuUf | 3145 | aUfcCfgAfuCfaCfacAfGfaCfaAfcsUfsu | 3796 |
| D-3132 | GfuUfgUfcUfgUfgUfGfauCfgGfaUfuUf | 3146 | aUfcCfgAfUfcaCfaCfaGfaCfaAfcsUfsu | 3797 |
| D-3133 | GfsusUfgUfcuGfUfgUfgAfuCfgGfaUfuUf | 3147 | asUfscCfgAfuCfaCfacAfGfaCfaAfcsUfsu | 3798 |
| D-3134 | GfuUfgUfcuGfUfgUfgAfuCfgGfaUfuUf | 3148 | aUfcCfgAfuCfaCfacAfGfaCfaAfcUfu | 3799 |
| D-3135 | GfsusUfgUfcUfgUfgUfGfauCfgGfaUfuUf | 3149 | asUfscCfgAfUfcaCfaCfaGfaCfaAfcsUfsu | 3800 |
| D-3136 | GfuUfgUfcUfgUfgUfGfauCfgGfaUfuUf | 3150 | aUfcCfgAfUfcaCfaCfaGfaCfaAfcUfu | 3801 |
| D-3137 | GfuUfgUfCfugUfgUfgAfuCfgGfaUfuUf | 3151 | aUfcCfgAfuCfaCfaCfAfgaCfaAfcsUfsu | 3802 |
| D-3138 | GfuUfguCfUfgUfgUfgAfuCfgGfaUfuUf | 3152 | aUfcCfgAfuCfaCfaCfagAfCfaAfcsUfsu | 3803 |
| D-3139 | GfuUfGfucUfgUfgUfgAfuCfgGfaUfuUf | 3153 | aUfcCfgAfuCfaCfaCfaGfAfcaAfcsUfsu | 3804 |
| D-3140 | GfuuGfUfcUfgUfgUfgAfuCfgGfaUfuUf | 3154 | aUfcCfgAfuCfaCfaCfaGfacAfAfcsUfsu | 3805 |
| D-3141 | GfUfugUfcUfgUfgUfgAfuCfgGfaUfuUf | 3155 | aUfcCfgAfuCfaCfaCfaGfaCfAfacsUfsu | 3806 |
| D-3142 | gUfUfgUfcUfgUfgUfgAfuCfgGfaUfuUf | 3156 | aUfcCfgAfuCfaCfaCfaGfaCfaaCfsUfsu | 3807 |
| D-3143 | guUfgUfcUfgUfgUfgAfuCfgGfaUfuUf | 3157 | aUfcCfgAfuCfaCfaCfaGfaCfaAfCfsusu | 3808 |
| D-3144 | GfuUfgUfcUfgUfgUfgaUfCfgGfaUfuUf | 3158 | aUfcCfgaUfCfaCfaCfaGfaCfaAfcsUfsu | 3809 |
| D-3145 | GfuUfgUfcUfgUfgUfgAfUfcgGfaUfuUf | 3159 | aUfcCfGfauCfaCfaCfaGfaCfaAfcsUfsu | 3810 |
| D-3146 | GfuUfgUfcUfgUfgUfgAfucGfGfaUfuUf | 3160 | aUfccGfAfuCfaCfaCfaGfaCfaAfcsUfsu | 3811 |
| D-3147 | GfuUfgUfcUfgUfgUfgAfuCfGfgaUfuUf | 3161 | aUfCfcgAfuCfaCfaCfaGfaCfaAfcsUfsu | 3812 |
| D-3148 | GfuUfgUfcUfgUfgUfgAfuCfggAfUfuUf | 3162 | auCfCfgAfuCfaCfaCfaGfaCfaAfcsUfsu | 3813 |
| D-3149 | GfuUfgUfcUfgUfgUfgAfuCfgGfAfuuUf | 3163 | AfucCfgAfuCfaCfaCfaGfaCfaAfcsUfsu | 3814 |
| D-3150 | GfuUfgUfcUfgUfgUfgAfuCfgGfauUfUf | 3164 | AfUfcCfgAfuCfaCfaCfaGfaCfaAfcsUfsu | 3815 |
| D-3151 | GfUfugUfCfugUfGfugAfUfcgGfAfuuUf | 3165 | AfucCfGfauCfAfcaCfAfgaCfAfacsUfsUf | 3816 |
| D-3152 | guUfGfucUfGfugUfGfauCfGfgaUfUfu | 3166 | aUfCfcgAfUfcaCfAfcaGfAfcaAfCfsusu | 3817 |
| D-3153 | GfuuGfUfcuGfUfguGfAfucGfGfauUfUf | 3167 | AfUfccGfAfucAfCfacAfGfacAfAfcsusUf | 3818 |
| D-3154 | gUfUfguCfUfguGfUfgaUfCfggAfUfuu | 3168 | auCfCfgaUfCfacAfCfagAfCfaaCfsUfsu | 3819 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3155 | GGAGcuGcGGGGccuGAGAdTsdT | 3169 | UCUcAGGCCCCGcAGCUCCdTsdT | 3820 |
| D-3156 | GfgAfgCfuGfCfGfGfGfgCfcUfgAfgAfuUf | 3170 | uCfuCfaGfgCfcccgcAfgCfuCfcsUfsu | 3821 |
| D-3157 | GfgAfgCfuGfCfgGfGfgCfcUfgAfgAfuUf | 3171 | uCfuCfaGfgCfccCfgcAfgCfuCfcsUfsu | 3822 |
| D-3158 | GfgAfgCfuGfcgGfGfgCfcUfgAfgAfuUf | 3172 | uCfuCfaGfgCfccCfGfcAfgCfuCfcsUfsu | 3823 |
| D-3159 | GfgAfgCfuGfcGfGfGfGfCfcUfgAfgAfuUf | 3173 | uCfuCfaGfgccccGfcAfgCfuCfcsUfsu | 3824 |
| D-3160 | GfgAfgCfuGfcGfGfgGfCfcUfgAfgAfuUf | 3174 | uCfuCfaGfgcCfccGfcAfgCfuCfcsUfsu | 3825 |
| D-3161 | GfgAfgCfuGfcGfGfggCfcUfgAfgAfuUf | 3175 | uCfuCfaGfgCfCfccGfcAfgCfuCfcsUfsu | 3826 |
| D-3162 | GfgAfgCfugCfGfgGfgCfcUfgAfgAfuUf | 3176 | uCfuCfaGfgCfcCfcgCfAfgCfuCfcsUfsu | 3827 |
| D-3163 | GfgAfgCfuGfcGfgGfGfccUfgAfgAfuUf | 3177 | uCfuCfaGfGfccCfcGfcAfgCfuCfcsUfsu | 3828 |
| D-3164 | GfsgsAfgCfugCfGfgGfgCfcUfgAfgAfuUf | 3178 | usCfsuCfaGfgCfcCfcgCfAfgCfuCfcsUfsu | 3829 |
| D-3165 | GfgAfgCfugCfGfgGfgCfcUfgAfgAfuUf | 3179 | uCfuCfaGfgCfcCfcgCfAfgCfuCfcUfu | 3830 |
| D-3166 | GfsgsAfgCfuGfcGfgGfGfccUfgAfgAfuUf | 3180 | usCfsuCfaGfGfccCfcGfcAfgCfuCfcsUfsu | 3831 |
| D-3167 | GfgAfgCfuGfcGfgGfGfccUfgAfgAfuUf | 3181 | uCfuCfaGfGfccCfcGfcAfgCfuCfcUfu | 3832 |
| D-3168 | GfgAfgCfUfgcGfgGfgCfcUfgAfgAfuUf | 3182 | uCfuCfaGfgCfcCfcGfCfagCfuCfcsUfsu | 3833 |
| D-3169 | GfgAfgcUfGfcGfgGfgCfcUfgAfgAfuUf | 3183 | uCfuCfaGfgCfcCfcGfcaGfCfuCfcsUfsu | 3834 |
| D-3170 | GfgAfGfcuGfcGfgGfgCfcUfgAfgAfuUf | 3184 | uCfuCfaGfgCfcCfcGfcAfGfcuCfcsUfsu | 3835 |
| D-3171 | GfgaGfCfuGfcGfgGfgCfcUfgAfgAfuUf | 3185 | uCfuCfaGfgCfcCfcGfcAfgcUfCfcsUfsu | 3836 |
| D-3172 | GfGfagCfuGfcGfgGfgCfcUfgAfgAfuUf | 3186 | uCfuCfaGfgCfcCfcGfcAfgCfUfccsUfsu | 3837 |
| D-3173 | gGfAfgCfuGfcGfgGfgCfcUfgAfgAfuUf | 3187 | uCfuCfaGfgCfcCfcGfcAfgCfucCfsUfsu | 3838 |
| D-3174 | ggAfgCfuGfcGfgGfgCfcUfgAfgAfuUf | 3188 | uCfuCfaGfgCfcCfcGfcAfgCfuCfCfsusu | 3839 |
| D-3175 | GfgAfgCfuGfcGfgGfgcCfUfgAfgAfuUf | 3189 | uCfuCfagGfCfcCfcGfcAfgCfuCfcsUfsu | 3840 |
| D-3176 | GfgAfgCfuGfcGfgGfgCfCfugAfgAfuUf | 3190 | uCfuCfAfggCfcCfcGfcAfgCfuCfcsUfsu | 3841 |
| D-3177 | GfgAfgCfuGfcGfgGfgCfcuGfAfgAfuUf | 3191 | uCfucAfGfgCfcCfcGfcAfgCfuCfcsUfsu | 3842 |
| D-3178 | GfgAfgCfuGfcGfgGfgCfcUfGfagAfuUf | 3192 | uCfUfcaGfgCfcCfcGfcAfgCfuCfcsUfsu | 3843 |
| D-3179 | GfgAfgCfuGfcGfgGfgCfcUfgaGfAfuUf | 3193 | ucUfCfaGfgCfcCfcGfcAfgCfuCfcsUfsu | 3844 |
| D-3180 | GfgAfgCfuGfcGfgGfgCfcUfgAfGfauUf | 3194 | UfcuCfaGfgCfcCfcGfcAfgCfuCfcsUfsu | 3845 |
| D-3181 | GfgAfgCfuGfcGfgGfgCfcUfgAfgaUfUf | 3195 | UfCfuCfaGfgCfcCfcGfcAfgCfuCfcsUfsu | 3846 |
| D-3182 | GfGfagCfUfgcGfGfggCfCfugAfGfauUf | 3196 | UfcuCfAfggCfCfccGfCfagCfUfccsUfsUf | 3847 |
| D-3183 | ggAfGfcuGfCfggGfGfccUfGfagAfUfu | 3197 | uCfUfcaGfGfccCfCfgcAfGfcuCfCfsusu | 3848 |
| D-3184 | GfgaGfCfugCfGfggGfCfcuGfAfgaUfUf | 3198 | UfCfucAfGfgcCfCfcgCfAfgcUfCfcsusUf | 3849 |
| D-3185 | gGfAfgcUfGfcgGfGfgcCfUfgaGfAfuu | 3199 | ucUfCfagGfCfccCfGfcaGfCfucCfsUfsu | 3850 |
| D-3186 | GccGcuGGAAcGAcGAcGudTsdT | 3200 | ACGUCGUCGUUCcAGCGGCdTsdT | 3851 |
| D-3187 | GfcCfgCfuGfGfAfAfCfgAfcGfaCfgUfuUf | 3201 | aCfgUfcGfuCfguuccAfgCfgGfcsUfsu | 3852 |
| D-3188 | GfcCfgCfuGfGfaAfCfgAfcGfaCfgUfuUf | 3202 | aCfgUfcGfuCfguUfccAfgCfgGfcsUfsu | 3853 |
| D-3189 | GfcCfgCfuGfgaAfCfgAfcGfaCfgUfuUf | 3203 | aCfgUfcGfuCfguUfCfcAfgCfgGfcsUfsu | 3854 |
| D-3190 | GfcCfgCfuGfgAfAfCfGfAfcGfaCfgUfuUf | 3204 | aCfgUfcGfucguuCfcAfgCfgGfcsUfsu | 3855 |
| D-3191 | GfcCfgCfuGfgAfAfcGfAfcGfaCfgUfuUf | 3205 | aCfgUfcGfucGfuuCfcAfgCfgGfcsUfsu | 3856 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3192 | GfcCfgCfuGfgAfAfcgAfcGfaCfgUfuUf | 3206 | aCfgUfcGfuCfGfuuCfcAfgCfgGfcsUfsu | 3857 |
| D-3193 | GfcCfgCfugGfAfaCfgAfcGfaCfgUfuUf | 3207 | aCfgUfcGfuCfgUfucCfAfgCfgGfcsUfsu | 3858 |
| D-3194 | GfcCfgCfuGfgAfaCfGfacGfaCfgUfuUf | 3208 | aCfgUfcGfUfcgUfuCfcAfgCfgGfcsUfsu | 3859 |
| D-3195 | GfscsCfgCfugGfAfaCfgAfcGfaCfgUfuUf | 3209 | asCfsgUfcGfuCfgUfucCfAfgCfgGfcsUfsu | 3860 |
| D-3196 | GfcCfgCfugGfAfaCfgAfcGfaCfgUfuUf | 3210 | aCfgUfcGfuCfgUfucCfAfgCfgGfcUfu | 3861 |
| D-3197 | GfscsCfgCfuGfgAfaCfGfacGfaCfgUfuUf | 3211 | asCfsgUfcGfUfcgUfuCfcAfgCfgGfcsUfsu | 3862 |
| D-3198 | GfcCfgCfuGfgAfaCfGfacGfaCfgUfuUf | 3212 | aCfgUfcGfUfcgUfuCfcAfgCfgGfcUfu | 3863 |
| D-3199 | GfcCfgCfUfggAfaCfgAfcGfaCfgUfuUf | 3213 | aCfgUfcGfuCfgUfuCfCfagCfgGfcsUfsu | 3864 |
| D-3200 | GfcCfgcUfGfgAfaCfgAfcGfaCfgUfuUf | 3214 | aCfgUfcGfuCfgUfuCfcaGfCfgGfcsUfsu | 3865 |
| D-3201 | GfcCfGfcuGfgAfaCfgAfcGfaCfgUfuUf | 3215 | aCfgUfcGfuCfgUfuCfcAfGfcgGfcsUfsu | 3866 |
| D-3202 | GfccGfCfuGfgAfaCfgAfcGfaCfgUfuUf | 3216 | aCfgUfcGfuCfgUfuCfcAfgcGfGfcsUfsu | 3867 |
| D-3203 | GfCfcgCfuGfgAfaCfgAfcGfaCfgUfuUf | 3217 | aCfgUfcGfuCfgUfuCfcAfgCfGfgcsUfsu | 3868 |
| D-3204 | gCfCfgCfuGfgAfaCfgAfcGfaCfgUfuUf | 3218 | aCfgUfcGfuCfgUfuCfcAfgCfggCfsUfsu | 3869 |
| D-3205 | gcCfgCfuGfgAfaCfgAfcGfaCfgUfuUf | 3219 | aCfgUfcGfuCfgUfuCfcAfgCfgGfCfsusu | 3870 |
| D-3206 | GfcCfgCfuGfgAfaCfgaCfGfaCfgUfuUf | 3220 | aCfgUfcgUfCfgUfuCfcAfgCfgGfcsUfsu | 3871 |
| D-3207 | GfcCfgCfuGfgAfaCfgAfCfgaCfgUfuUf | 3221 | aCfgUfCfguCfgUfuCfcAfgCfgGfcsUfsu | 3872 |
| D-3208 | GfcCfgCfuGfgAfaCfgAfcgAfCfgUfuUf | 3222 | aCfguCfGfuCfgUfuCfcAfgCfgGfcsUfsu | 3873 |
| D-3209 | GfcCfgCfuGfgAfaCfgAfcGfAfcgUfuUf | 3223 | aCfGfucGfuCfgUfuCfcAfgCfgGfcsUfsu | 3874 |
| D-3210 | GfcCfgCfuGfgAfaCfgAfcGfacGfUfuUf | 3224 | acGfUfcGfuCfgUfuCfcAfgCfgGfcsUfsu | 3875 |
| D-3211 | GfcCfgCfuGfgAfaCfgAfcGfaCfGfuuUf | 3225 | AfcgUfcGfuCfgUfuCfcAfgCfgGfcsUfsu | 3876 |
| D-3212 | GfcCfgCfuGfgAfaCfgAfcGfaCfguUfUf | 3226 | AfCfgUfcGfuCfgUfuCfcAfgCfgGfcsUfsu | 3877 |
| D-3213 | GfCfcgCfUfggAfAfcgAfCfgaCfGfuuUf | 3227 | AfcgUfCfguCfGfuuCfCfagCfGfgcsUfsUf | 3878 |
| D-3214 | gcCfGfcuGfGfaaCfGfacGfAfcgUfUfu | 3228 | aCfGfucGfUfcgUfUfccAfGfcgGfCfsusu | 3879 |
| D-3215 | GfccGfCfugGfAfacGfAfcgAfCfguUfUf | 3229 | AfCfguCfGfucGfUfucCfAfgcGfGfcsusUf | 3880 |
| D-3216 | gCfCfgcUfGfgaAfCfgaCfGfacGfUfuu | 3230 | acGfUfcgUfCfguUfCfcaGfCfggCfsUfsu | 3881 |
| D-3217 | GcAGcuGcuAcuGGuucucdTsdT | 3231 | GAGAACcAGuAGcAGCUGCdTsdT | 3882 |
| D-3218 | GfcAfgCfuGfCfUfAfCfuGfgUfuCfuCfuUf | 3232 | gAfgAfaCfcAfguagcAfgCfuGfcsUfsu | 3883 |
| D-3219 | GfcAfgCfuGfCfuAfCfuGfgUfuCfuCfuUf | 3233 | gAfgAfaCfcAfguAfgcAfgCfuGfcsUfsu | 3884 |
| D-3220 | GfcAfgCfuGfcuAfCfuGfgUfuCfuCfuUf | 3234 | gAfgAfaCfcAfguAfGfcAfgCfuGfcsUfsu | 3885 |
| D-3221 | GfcAfgCfuGfcUfAfCfUfGfgUfuCfuCfuUf | 3235 | gAfgAfaCfcaguaGfcAfgCfuGfcsUfsu | 3886 |
| D-3222 | GfcAfgCfuGfcUfAfcUfGfgUfuCfuCfuUf | 3236 | gAfgAfaCfcaGfuaGfcAfgCfuGfcsUfsu | 3887 |
| D-3223 | GfcAfgCfuGfcUfAfcuGfgUfuCfuCfuUf | 3237 | gAfgAfaCfcAfGfuaGfcAfgCfuGfcsUfsu | 3888 |
| D-3224 | GfcAfgCfugCfUfaCfuGfgUfuCfuCfuUf | 3238 | gAfgAfaCfcAfgUfagCfAfgCfuGfcsUfsu | 3889 |
| D-3225 | GfcAfgCfuGfcUfaCfUfggUfuCfuCfuUf | 3239 | gAfgAfaCfCfagUfaGfcAfgCfuGfcsUfsu | 3890 |
| D-3226 | GfscsAfgCfugCfUfaCfuGfgUfuCfuCfuUf | 3240 | gsAfsgAfaCfcAfgUfagCfAfgCfuGfcsUfsu | 3891 |
| D-3227 | GfcAfgCfugCfUfaCfuGfgUfuCfuCfuUf | 3241 | gAfgAfaCfcAfgUfagCfAfgCfuGfcUfu | 3892 |
| D-3228 | GfscsAfgCfuGfcUfaCfUfggUfuCfuCfuUf | 3242 | gsAfsgAfaCfCfagUfaGfcAfgCfuGfcsUfsu | 3893 |
| D-3229 | GfcAfgCfuGfcUfaCfUfggUfuCfuCfuUf | 3243 | gAfgAfaCfCfagUfaGfcAfgCfuGfcUfu | 3894 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3230 | GfcAfgCfUfgcUfaCfuGfgUfuCfuCfuUf | 3244 | gAfgAfaCfcAfgUfaGfCfagCfuGfcsUfsu | 3895 |
| D-3231 | GfcAfgcUfGfcUfaCfuGfgUfuCfuCfuUf | 3245 | gAfgAfaCfcAfgUfaGfcaGfCfuGfcsUfsu | 3896 |
| D-3232 | GfcAfGfcuGfcUfaCfuGfgUfuCfuCfuUf | 3246 | gAfgAfaCfcAfgUfaGfcAfGfcuGfcsUfsu | 3897 |
| D-3233 | GfcaGfCfuGfcUfaCfuGfgUfuCfuCfuUf | 3247 | gAfgAfaCfcAfgUfaGfcAfgcUfGfcsUfsu | 3898 |
| D-3234 | GfCfagCfuGfcUfaCfuGfgUfuCfuCfuUf | 3248 | gAfgAfaCfcAfgUfaGfcAfgCfUfgcsUfsu | 3899 |
| D-3235 | gCfAfgCfuGfcUfaCfuGfgUfuCfuCfuUf | 3249 | gAfgAfaCfcAfgUfaGfcAfgCfugCfsUfsu | 3900 |
| D-3236 | gcAfgCfuGfcUfaCfuGfgUfuCfuCfuUf | 3250 | gAfgAfaCfcAfgUfaGfcAfgCfuGfCfsusu | 3901 |
| D-3237 | GfcAfgCfuGfcUfaCfugGfUfuCfuCfuUf | 3251 | gAfgAfacCfAfgUfaGfcAfgCfuGfcsUfsu | 3902 |
| D-3238 | GfcAfgCfuGfcUfaCfuGfGfuuCfuCfuUf | 3252 | gAfgAfAfccAfgUfaGfcAfgCfuGfcsUfsu | 3903 |
| D-3239 | GfcAfgCfuGfcUfaCfuGfguUfCfuCfuUf | 3253 | gAfgaAfCfcAfgUfaGfcAfgCfuGfcsUfsu | 3904 |
| D-3240 | GfcAfgCfuGfcUfaCfuGfgUfUfcuCfuUf | 3254 | gAfGfaaCfcAfgUfaGfcAfgCfuGfcsUfsu | 3905 |
| D-3241 | GfcAfgCfuGfcUfaCfuGfgUfucUfCfuUf | 3255 | gaGfAfaCfcAfgUfaGfcAfgCfuGfcsUfsu | 3906 |
| D-3242 | GfcAfgCfuGfcUfaCfuGfgUfuCfUfcuUf | 3256 | GfagAfaCfcAfgUfaGfcAfgCfuGfcsUfsu | 3907 |
| D-3243 | GfcAfgCfuGfcUfaCfuGfgUfuCfucUfUf | 3257 | GfAfgAfaCfcAfgUfaGfcAfgCfuGfcsUfsu | 3908 |
| D-3244 | GfCfagCfUfgcUfAfcuGfGfuuCfUfcuUf | 3258 | GfagAfAfccAfGfuaGfCfagCfUfgcsUfsUf | 3909 |
| D-3245 | gcAfGfcuGfCfuaCfUfggUfUfcuCfUfu | 3259 | gAfGfaaCfCfagUfAfgcAfGfcuGfCfsusu | 3910 |
| D-3246 | GfcaGfCfugCfUfacUfGfguUfCfucUfUf | 3260 | GfAfgaAfCfcaGfUfagCfAfgcUfGfcsusUf | 3911 |
| D-3247 | gCfAfgcUfGfcuAfCfugGfUfucUfCfuu | 3261 | gaGfAfacCfAfguAfGfcaGfCfugCfsUfsu | 3912 |
| D-3248 | GcuGGGucuGcGAGAcAGAdTsdT | 3262 | UCUGUCUCGcAGACCcAGCdTsdT | 3913 |
| D-3249 | GfcUfgGfgUfCfUfGfCfgAfgAfcAfgAfuUf | 3263 | uCfuGfuCfuCfgcagaCfcCfaGfcsUfsu | 3914 |
| D-3250 | GfcUfgGfgUfCfuGfCfgAfgAfcAfgAfuUf | 3264 | uCfuGfuCfuCfgcAfgaCfcCfaGfcsUfsu | 3915 |
| D-3251 | GfcUfgGfgUfcuGfCfgAfgAfcAfgAfuUf | 3265 | uCfuGfuCfuCfgcAfGfaCfcCfaGfcsUfsu | 3916 |
| D-3252 | GfcUfgGfgUfcUfGfCfGfAfgAfcAfgAfuUf | 3266 | uCfuGfuCfucgcaGfaCfcCfaGfcsUfsu | 3917 |
| D-3253 | GfcUfgGfgUfcUfGfcGfAfgAfcAfgAfuUf | 3267 | uCfuGfuCfucGfcaGfaCfcCfaGfcsUfsu | 3918 |
| D-3254 | GfcUfgGfgUfcUfGfcgAfgAfcAfgAfuUf | 3268 | uCfuGfuCfuCfGfcaGfaCfcCfaGfcsUfsu | 3919 |
| D-3255 | GfcUfgGfguCfUfgCfgAfgAfcAfgAfuUf | 3269 | uCfuGfuCfuCfgCfagAfCfcCfaGfcsUfsu | 3920 |
| D-3256 | GfcUfgGfgUfcUfgCfGfagAfcAfgAfuUf | 3270 | uCfuGfuCfUfcgCfaGfaCfcCfaGfcsUfsu | 3921 |
| D-3257 | GfscsUfgGfguCfUfgCfgAfgAfcAfgAfuUf | 3271 | usCfsuGfuCfuCfgCfagAfCfcCfaGfcsUfsu | 3922 |
| D-3258 | GfcUfgGfguCfUfgCfgAfgAfcAfgAfuUf | 3272 | uCfuGfuCfuCfgCfagAfCfcCfaGfcUfu | 3923 |
| D-3259 | GfscsUfgGfgUfcUfgCfGfagAfcAfgAfuUf | 3273 | usCfsuGfuCfUfcgCfaGfaCfcCfaGfcsUfsu | 3924 |
| D-3260 | GfcUfgGfgUfcUfgCfGfagAfcAfgAfuUf | 3274 | uCfuGfuCfUfcgCfaGfaCfcCfaGfcUfu | 3925 |
| D-3261 | GfcUfgGfGfucUfgCfgAfgAfcAfgAfuUf | 3275 | uCfuGfuCfuCfgCfaGfAfccCfaGfcsUfsu | 3926 |
| D-3262 | GfcUfggGfUfcUfgCfgAfgAfcAfgAfuUf | 3276 | uCfuGfuCfuCfgCfaGfacCfCfaGfcsUfsu | 3927 |
| D-3263 | GfcUfGfggUfcUfgCfgAfgAfcAfgAfuUf | 3277 | uCfuGfuCfuCfgCfaGfaCfCfcaGfcsUfsu | 3928 |
| D-3264 | GfcuGfGfgUfcUfgCfgAfgAfcAfgAfuUf | 3278 | uCfuGfuCfuCfgCfaGfaCfccAfGfcsUfsu | 3929 |
| D-3265 | GfCfugGfgUfcUfgCfgAfgAfcAfgAfuUf | 3279 | uCfuGfuCfuCfgCfaGfaCfcCfAfgcsUfsu | 3930 |
| D-3266 | gCfUfgGfgUfcUfgCfgAfgAfcAfgAfuUf | 3280 | uCfuGfuCfuCfgCfaGfaCfcCfagCfsUfsu | 3931 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3267 | gcUfgGfgUfcUfgCfgAfgAfcAfgAfuUf | 3281 | uCfuGfuCfuCfgCfaGfaCfcCfaGfCfsusu | 3932 |
| D-3268 | GfcUfgGfgUfcUfgCfgaGfAfcAfgAfuUf | 3282 | uCfuGfucUfCfgCfaGfaCfcCfaGfcsUfsu | 3933 |
| D-3269 | GfcUfgGfgUfcUfgCfgAfGfacAfgAfuUf | 3283 | uCfuGfUfcuCfgCfaGfaCfcCfaGfcsUfsu | 3934 |
| D-3270 | GfcUfgGfgUfcUfgCfgAfgaCfAfgAfuUf | 3284 | uCfugUfCfuCfgCfaGfaCfcCfaGfcsUfsu | 3935 |
| D-3271 | GfcUfgGfgUfcUfgCfgAfgAfCfagAfuUf | 3285 | uCfUfguCfuCfgCfaGfaCfcCfaGfcsUfsu | 3936 |
| D-3272 | GfcUfgGfgUfcUfgCfgAfgAfcaGfAfuUf | 3286 | ucUfGfuCfuCfgCfaGfaCfcCfaGfcsUfsu | 3937 |
| D-3273 | GfcUfgGfgUfcUfgCfgAfgAfcAfGfauUf | 3287 | UfcuGfuCfuCfgCfaGfaCfcCfaGfcsUfsu | 3938 |
| D-3274 | GfcUfgGfgUfcUfgCfgAfgAfcAfgaUfUf | 3288 | UfCfuGfuCfuCfgCfaGfaCfcCfaGfcsUfsu | 3939 |
| D-3275 | GfCfugGfGfucUfGfcgAfGfacAfGfauUf | 3289 | UfcuGfUfcuCfGfcaGfAfccCfAfgcsUfsUf | 3940 |
| D-3276 | gcUfGfggUfCfugCfGfagAfCfagAfUfu | 3290 | uCfUfguCfUfcgCfAfgaCfCfcaGfCfsusu | 3941 |
| D-3277 | GfcuGfGfguCfUfgcGfAfgaCfAfgaUfUf | 3291 | UfCfugUfCfucGfCfagAfCfccAfGfcsusUf | 3942 |
| D-3278 | gCfUfggGfUfcuGfCfgaGfAfcaGfAfuu | 3292 | ucUfGfucUfCfgcAfGfacCfCfagCfsUfsu | 3943 |
| D-3279 | GcuuucucGGGAAuuuucAdTsdT | 3293 | UGAAAAUUCCCGAGAAAGCdTsdT | 3944 |
| D-3280 | GfcUfuUfcUfCfGfGfGfaAfuUfuUfcAfuUf | 3294 | uGfaAfaAfuUfcccgaGfaAfaGfcsUfsu | 3945 |
| D-3281 | GfcUfuUfcUfCfgGfGfaAfuUfuUfcAfuUf | 3295 | uGfaAfaAfuUfccCfgaGfaAfaGfcsUfsu | 3946 |
| D-3282 | GfcUfuUfcUfcgGfGfaAfuUfuUfcAfuUf | 3296 | uGfaAfaAfuUfccCfGfaGfaAfaGfcsUfsu | 3947 |
| D-3283 | GfcUfuUfcUfcGfGfGfAfAfuUfuUfcAfuUf | 3297 | uGfaAfaAfuucccGfaGfaAfaGfcsUfsu | 3948 |
| D-3284 | GfcUfuUfcUfcGfGfgAfAfuUfuUfcAfuUf | 3298 | uGfaAfaAfuuCfccGfaGfaAfaGfcsUfsu | 3949 |
| D-3285 | GfcUfuUfcUfcGfGfgaAfuUfuUfcAfuUf | 3299 | uGfaAfaAfuUfCfccGfaGfaAfaGfcsUfsu | 3950 |
| D-3286 | GfcUfuUfcuCfGfgGfaAfuUfuUfcAfuUf | 3300 | uGfaAfaAfuUfcCfcgAfGfaAfaGfcsUfsu | 3951 |
| D-3287 | GfcUfuUfcUfcGfgGfAfauUfuUfcAfuUf | 3301 | uGfaAfaAfUfucCfcGfaGfaAfaGfcsUfsu | 3952 |
| D-3288 | GfscsUfuUfcuCfGfgGfaAfuUfuUfcAfuUf | 3302 | usGfsaAfaAfuUfcCfcgAfGfaAfaGfcsUfsu | 3953 |
| D-3289 | GfcUfuUfcuCfGfgGfaAfuUfuUfcAfuUf | 3303 | uGfaAfaAfuUfcCfcgAfGfaAfaGfcUfu | 3954 |
| D-3290 | GfscsUfuUfcUfcGfgGfAfauUfuUfcAfuUf | 3304 | usGfsaAfaAfUfucCfcGfaGfaAfaGfcsUfsu | 3955 |
| D-3291 | GfcUfuUfcUfcGfgGfAfauUfuUfcAfuUf | 3305 | uGfaAfaAfUfucCfcGfaGfaAfaGfcUfu | 3956 |
| D-3292 | GfcUfuUfCfucGfgGfaAfuUfuUfcAfuUf | 3306 | uGfaAfaAfuUfcCfcGfAfgaAfaGfcsUfsu | 3957 |
| D-3293 | GfcUfuuCfUfcGfgGfaAfuUfuUfcAfuUf | 3307 | uGfaAfaAfuUfcCfcGfagAfAfaGfcsUfsu | 3958 |
| D-3294 | GfcUfUfucUfcGfgGfaAfuUfuUfcAfuUf | 3308 | uGfaAfaAfuUfcCfcGfaGfAfaaGfcsUfsu | 3959 |
| D-3295 | GfcuUfUfcUfcGfgGfaAfuUfuUfcAfuUf | 3309 | uGfaAfaAfuUfcCfcGfaGfaaAfGfcsUfsu | 3960 |
| D-3296 | GfCfuuUfcUfcGfgGfaAfuUfuUfcAfuUf | 3310 | uGfaAfaAfuUfcCfcGfaGfaAfAfgcsUfsu | 3961 |
| D-3297 | gCfUfuUfcUfcGfgGfaAfuUfuUfcAfuUf | 3311 | uGfaAfaAfuUfcCfcGfaGfaAfagCfsUfsu | 3962 |
| D-3298 | gcUfuUfcUfcGfgGfaAfuUfuUfcAfuUf | 3312 | uGfaAfaAfuUfcCfcGfaGfaAfaGfCfsusu | 3963 |
| D-3299 | GfcUfuUfcUfcGfgGfaaUfUfuUfcAfuUf | 3313 | uGfaAfaaUfUfcCfcGfaGfaAfaGfcsUfsu | 3964 |
| D-3300 | GfcUfuUfcUfcGfgGfaAfUfuuUfcAfuUf | 3314 | uGfaAfAfauUfcCfcGfaGfaAfaGfcsUfsu | 3965 |
| D-3301 | GfcUfuUfcUfcGfgGfaAfuuUfUfcAfuUf | 3315 | uGfaaAfAfuUfcCfcGfaGfaAfaGfcsUfsu | 3966 |
| D-3302 | GfcUfuUfcUfcGfgGfaAfuUfUfucAfuUf | 3316 | uGfAfaaAfuUfcCfcGfaGfaAfaGfcsUfsu | 3967 |
| D-3303 | GfcUfuUfcUfcGfgGfaAfuUfuuCfAfuUf | 3317 | ugAfAfaAfuUfcCfcGfaGfaAfaGfcsUfsu | 3968 |
| D-3304 | GfcUfuUfcUfcGfgGfaAfuUfuUfCfauUf | 3318 | UfgaAfaAfuUfcCfcGfaGfaAfaGfcsUfsu | 3969 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3305 | GfcUfuUfcUfcGfgGfaAfuUfuUfcaUfUf | 3319 | UfGfaAfaAfuUfcCfcGfaGfaAfaGfcsUfsu | 3970 |
| D-3306 | GfCfuuUfCfucGfGfgaAfUfuuUfCfauUf | 3320 | UfgaAfAfauUfCfccGfAfgaAfAfgcsUfsUf | 3971 |
| D-3307 | gcUfUfucUfCfggGfAfauUfUfucAfUfu | 3321 | uGfAfaaAfUfucCfCfgaGfAfaaGfCfsusu | 3972 |
| D-3308 | GfcuUfUfcuCfGfggAfAfuuUfUfcaUfUf | 3322 | UfGfaaAfAfuuCfCfcgAfGfaaAfGfcsusUf | 3973 |
| D-3309 | gCfUfuuCfUfcgGfGfaaUfUfuuCfAfuu | 3323 | ugAfAfaaUfUfccCfGfagAfAfagCfsUfsu | 3974 |
| D-3310 | ccuccuGcuGcuuGuGGuudTsdT | 3324 | AACcAcAAGcAGcAGGAGGdTsdT | 3975 |
| D-3311 | CfcUfcCfuGfCfUfGfCfuUfgUfgGfuUfuUf | 3325 | aAfcCfaCfaAfgcagcAfgGfaGfgsUfsu | 3976 |
| D-3312 | CfcUfcCfuGfCfuGfCfuUfgUfgGfuUfuUf | 3326 | aAfcCfaCfaAfgcAfgcAfgGfaGfgsUfsu | 3977 |
| D-3313 | CfcUfcCfuGfcuGfCfuUfgUfgGfuUfuUf | 3327 | aAfcCfaCfaAfgcAfGfcAfgGfaGfgsUfsu | 3978 |
| D-3314 | CfcUfcCfuGfcUfGfCfUfUfgUfgGfuUfuUf | 3328 | aAfcCfaCfaagcaGfcAfgGfaGfgsUfsu | 3979 |
| D-3315 | CfcUfcCfuGfcUfGfcUfUfgUfgGfuUfuUf | 3329 | aAfcCfaCfaaGfcaGfcAfgGfaGfgsUfsu | 3980 |
| D-3316 | CfcUfcCfuGfcUfGfcuUfgUfgGfuUfuUf | 3330 | aAfcCfaCfaAfGfcaGfcAfgGfaGfgsUfsu | 3981 |
| D-3317 | CfcUfcCfugCfUfgCfuUfgUfgGfuUfuUf | 3331 | aAfcCfaCfaAfgCfagCfAfgGfaGfgsUfsu | 3982 |
| D-3318 | CfcUfcCfuGfcUfgCfUfugUfgGfuUfuUf | 3332 | aAfcCfaCfAfagCfaGfcAfgGfaGfgsUfsu | 3983 |
| D-3319 | CfscsUfcCfugCfUfgCfuUfgUfgGfuUfuUf | 3333 | asAfscCfaCfaAfgCfagCfAfgGfaGfgsUfsu | 3984 |
| D-3320 | CfcUfcCfugCfUfgCfuUfgUfgGfuUfuUf | 3334 | aAfcCfaCfaAfgCfagCfAfgGfaGfgUfu | 3985 |
| D-3321 | CfscsUfcCfuGfcUfgCfUfugUfgGfuUfuUf | 3335 | asAfscCfaCfAfagCfaGfcAfgGfaGfgsUfsu | 3986 |
| D-3322 | CfcUfcCfuGfcUfgCfUfugUfgGfuUfuUf | 3336 | aAfcCfaCfAfagCfaGfcAfgGfaGfgUfu | 3987 |
| D-3323 | CfcUfcCfUfgcUfgCfuUfgUfgGfuUfuUf | 3337 | aAfcCfaCfaAfgCfaGfCfagGfaGfgsUfsu | 3988 |
| D-3324 | CfcUfccUfGfcUfgCfuUfgUfgGfuUfuUf | 3338 | aAfcCfaCfaAfgCfaGfcaGfGfaGfgsUfsu | 3989 |
| D-3325 | CfcUfCfcuGfcUfgCfuUfgUfgGfuUfuUf | 3339 | aAfcCfaCfaAfgCfaGfcAfGfgaGfgsUfsu | 3990 |
| D-3326 | CfcuCfCfuGfcUfgCfuUfgUfgGfuUfuUf | 3340 | aAfcCfaCfaAfgCfaGfcAfggAfGfgsUfsu | 3991 |
| D-3327 | CfCfucCfuGfcUfgCfuUfgUfgGfuUfuUf | 3341 | aAfcCfaCfaAfgCfaGfcAfgGfAfggsUfsu | 3992 |
| D-3328 | cCfUfcCfuGfcUfgCfuUfgUfgGfuUfuUf | 3342 | aAfcCfaCfaAfgCfaGfcAfgGfagGfsUfsu | 3993 |
| D-3329 | ccUfcCfuGfcUfgCfuUfgUfgGfuUfuUf | 3343 | aAfcCfaCfaAfgCfaGfcAfgGfaGfGfsusu | 3994 |
| D-3330 | CfcUfcCfuGfcUfgCfuuGfUfgGfuUfuUf | 3344 | aAfcCfacAfAfgCfaGfcAfgGfaGfgsUfsu | 3995 |
| D-3331 | CfcUfcCfuGfcUfgCfuUfGfugGfuUfuUf | 3345 | aAfcCfAfcaAfgCfaGfcAfgGfaGfgsUfsu | 3996 |
| D-3332 | CfcUfcCfuGfcUfgCfuUfguGfGfuUfuUf | 3346 | aAfccAfCfaAfgCfaGfcAfgGfaGfgsUfsu | 3997 |
| D-3333 | CfcUfcCfuGfcUfgCfuUfgUfGfguUfuUf | 3347 | aAfCfcaCfaAfgCfaGfcAfgGfaGfgsUfsu | 3998 |
| D-3334 | CfcUfcCfuGfcUfgCfuUfgUfggUfUfuUf | 3348 | aaCfCfaCfaAfgCfaGfcAfgGfaGfgsUfsu | 3999 |
| D-3335 | CfcUfcCfuGfcUfgCfuUfgUfgGfUfuuUf | 3349 | AfacCfaCfaAfgCfaGfcAfgGfaGfgsUfsu | 4000 |
| D-3336 | CfcUfcCfuGfcUfgCfuUfgUfgGfuuUfUf | 3350 | AfAfcCfaCfaAfgCfaGfcAfgGfaGfgsUfsu | 4001 |
| D-3337 | CfCfucCfUfgcUfGfcuUfGfugGfUfuuUf | 3351 | AfacCfAfcaAfGfcaGfCfagGfAfggsUfsUf | 4002 |
| D-3338 | ccUfCfcuGfCfugCfUfugUfGfguUfUfu | 3352 | aAfCfcaCfAfagCfAfgcAfGfgaGfGfsusu | 4003 |
| D-3339 | CfcuCfCfugCfUfgcUfUfguGfGfuuUfUf | 3353 | AfAfccAfCfaaGfCfagCfAfggAfGfgsusUf | 4004 |
| D-3340 | cCfUfccUfGfcuGfCfuuGfUfggUfUfuu | 3354 | aaCfCfacAfAfgcAfGfcaGfGfagGfsUfsu | 4005 |
| D-3341 | cuAucAuGAccAAGGAGuAdTsdT | 3355 | uACUCCUUGGUcAUGAuAGdTsdT | 4006 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3342 | CfuAfuCfaUfGfAfCfCfaAfgGfaGfuAfuUf | 3356 | uAfcUfcCfuUfggucaUfgAfuAfgsUfsu | 4007 |
| D-3343 | CfuAfuCfaUfGfaCfCfaAfgGfaGfuAfuUf | 3357 | uAfcUfcCfuUfggUfcaUfgAfuAfgsUfsu | 4008 |
| D-3344 | CfuAfuCfaUfgaCfCfaAfgGfaGfuAfuUf | 3358 | uAfcUfcCfuUfggUfCfaUfgAfuAfgsUfsu | 4009 |
| D-3345 | CfuAfuCfaUfgAfCfCfAfAfgGfaGfuAfuUf | 3359 | uAfcUfcCfuuggucfaUfgAfuAfgsUfsu | 4010 |
| D-3346 | CfuAfuCfaUfgAfCfcAfAfgGfaGfuAfuUf | 3360 | uAfcUfcCfuuGfguCfaUfgAfuAfgsUfsu | 4011 |
| D-3347 | CfuAfuCfaUfgAfCfcaAfgGfaGfuAfuUf | 3361 | uAfcUfcCfuUfGfguCfaUfgAfuAfgsUfsu | 4012 |
| D-3348 | CfuAfuCfauGfAfcCfaAfgGfaGfuAfuUf | 3362 | uAfcUfcCfuUfgGfucAfUfgAfuAfgsUfsu | 4013 |
| D-3349 | CfuAfuCfaUfgAfcCfAfagGfaGfuAfuUf | 3363 | uAfcUfcCfUfugGfuCfaUfgAfuAfgsUfsu | 4014 |
| D-3350 | CfsusAfuCfauGfAfcCfaAfgGfaGfuAfuUf | 3364 | usAfscUfcCfuUfgGfucAfUfgAfuAfgsUfsu | 4015 |
| D-3351 | CfuAfuCfauGfAfcCfaAfgGfaGfuAfuUf | 3365 | uAfcUfcCfuUfgGfucAfUfgAfuAfgUfu | 4016 |
| D-3352 | CfsusAfuCfaUfgAfcCfAfagGfaGfuAfuUf | 3366 | usAfscUfcCfUfugGfuCfaUfgAfuAfgsUfsu | 4017 |
| D-3353 | CfuAfuCfaUfgAfcCfAfagGfaGfuAfuUf | 3367 | uAfcUfcCfUfugGfuCfaUfgAfuAfgUfu | 4018 |
| D-3354 | CfuAfuCfAfugAfcCfaAfgGfaGfuAfuUf | 3368 | uAfcUfcCfuUfgGfuCfAfugAfuAfgsUfsu | 4019 |
| D-3355 | CfuAfucAfUfgAfcCfaAfgGfaGfuAfuUf | 3369 | uAfcUfcCfuUfgGfuCfauGfAfuAfgsUfsu | 4020 |
| D-3356 | CfuAfUfcaUfgAfcCfaAfgGfaGfuAfuUf | 3370 | uAfcUfcCfuUfgGfuCfaUfGfauAfgsUfsu | 4021 |
| D-3357 | CfuaUfCfaUfgAfcCfaAfgGfaGfuAfuUf | 3371 | uAfcUfcCfuUfgGfuCfaUfgaUfAfgsUfsu | 4022 |
| D-3358 | CfUfauCfaUfgAfcCfaAfgGfaGfuAfuUf | 3372 | uAfcUfcCfuUfgGfuCfaUfgAfUfagsUfsu | 4023 |
| D-3359 | cUfAfuCfaUfgAfcCfaAfgGfaGfuAfuUf | 3373 | uAfcUfcCfuUfgGfuCfaUfgAfuaGfsUfsu | 4024 |
| D-3360 | cuAfuCfaUfgAfcCfaAfgGfaGfuAfuUf | 3374 | uAfcUfcCfuUfgGfuCfaUfgAfuAfGfsusu | 4025 |
| D-3361 | CfuAfuCfaUfgAfcCfaaGfGfaGfuAfuUf | 3375 | uAfcUfccUfUfgGfuCfaUfgAfuAfgsUfsu | 4026 |
| D-3362 | CfuAfuCfaUfgAfcCfaAfGfgaGfuAfuUf | 3376 | uAfcUfCfcuUfgGfuCfaUfgAfuAfgsUfsu | 4027 |
| D-3363 | CfuAfuCfaUfgAfcCfaAfggAfGfuAfuUf | 3377 | uAfcuCfCfuUfgGfuCfaUfgAfuAfgsUfsu | 4028 |
| D-3364 | CfuAfuCfaUfgAfcCfaAfgGfAfguAfuUf | 3378 | uAfCfucCfuUfgGfuCfaUfgAfuAfgsUfsu | 4029 |
| D-3365 | CfuAfuCfaUfgAfcCfaAfgGfagUfAfuUf | 3379 | uaCfUfcCfuUfgGfuCfaUfgAfuAfgsUfsu | 4030 |
| D-3366 | CfuAfuCfaUfgAfcCfaAfgGfaGfUfauUf | 3380 | UfacUfcCfuUfgGfuCfaUfgAfuAfgsUfsu | 4031 |
| D-3367 | CfuAfuCfaUfgAfcCfaAfgGfaGfuaUfUf | 3381 | UfAfcUfcCfuUfgGfuCfaUfgAfuAfgsUfsu | 4032 |
| D-3368 | CfUfauCfAfugAfCfcaAfGfgaGfUfauUf | 3382 | UfacUfCfcuUfGfguCfAfugAfUfagsUfsUf | 4033 |
| D-3369 | cuAfUfcaUfGfacCfAfagGfAfguAfUfu | 3383 | uAfCfucCfUfugGfUfcaUfGfauAfGfsusu | 4034 |
| D-3370 | CfuaUfCfauGfAfccAfAfggAfGfuaUfUf | 3384 | UfAfcuCfCfuuGfGfucAfUfgaUfAfgsusUf | 4035 |
| D-3371 | cUfAfucAfUfgaCfCfaaGfGfagUfAfuu | 3385 | uaCfUfccUfUfggUfCfauGfAfuaGfsUfsu | 4036 |
| D-3372 | cGuccuGGGAGGAGcAGAAdTsdT | 3386 | UUCUGCUCCUCCcAGGACGdTsdT | 4037 |
| D-3373 | CfgUfcCfuGfGfGfAfGfgAfgCfaGfaAfuUf | 3387 | uUfcUfgCfuCfcucccAfgGfaCfgsUfsu | 4038 |
| D-3374 | CfgUfcCfuGfGfgAfGfgAfgCfaGfaAfuUf | 3388 | uUfcUfgCfuCfcuCfccAfgGfaCfgsUfsu | 4039 |
| D-3375 | CfgUfcCfuGfggAfGfgAfgCfaGfaAfuUf | 3389 | uUfcUfgCfuCfcuCfCfcAfgGfaCfgsUfsu | 4040 |
| D-3376 | CfgUfcCfuGfgGfAfGfGfAfgCfaGfaAfuUf | 3390 | uUfcUfgCfuccucCfcAfgGfaCfgsUfsu | 4041 |
| D-3377 | CfgUfcCfuGfgGfAfgGfAfgCfaGfaAfuUf | 3391 | uUfcUfgCfucCfucCfcAfgGfaCfgsUfsu | 4042 |
| D-3378 | CfgUfcCfuGfgGfAfggAfgCfaGfaAfuUf | 3392 | uUfcUfgCfuCfCfucCfcAfgGfaCfgsUfsu | 4043 |
| D-3379 | CfgUfcCfugGfGfaGfgAfgCfaGfaAfuUf | 3393 | uUfcUfgCfuCfcUfccCfAfgGfaCfgsUfsu | 4044 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3380 | CfgUfcCfuGfgGfaGfGfagCfaGfaAfuUf | 3394 | uUfcUfgCfUfccUfcCfcAfgGfaCfgsUfsu | 4045 |
| D-3381 | CfsgsUfcCfugGfGfaGfgAfgCfaGfaAfuUf | 3395 | usUfscUfgCfuCfcUfccCfAfgGfaCfgsUfsu | 4046 |
| D-3382 | CfgUfcCfugGfGfaGfgAfgCfaGfaAfuUf | 3396 | uUfcUfgCfuCfcUfccCfAfgGfaCfgUfu | 4047 |
| D-3383 | CfsgsUfcCfuGfgGfaGfGfagCfaGfaAfuUf | 3397 | usUfscUfgCfUfccUfcCfcAfgGfaCfgsUfsu | 4048 |
| D-3384 | CfgUfcCfuGfgGfaGfGfagCfaGfaAfuUf | 3398 | uUfcUfgCfUfccUfcCfcAfgGfaCfgUfu | 4049 |
| D-3385 | CfgUfcCfUfggGfaGfgAfgCfaGfaAfuUf | 3399 | uUfcUfgCfuCfcUfcCfCfagGfaCfgsUfsu | 4050 |
| D-3386 | CfgUfccUfGfgGfaGfgAfgCfaGfaAfuUf | 3400 | uUfcUfgCfuCfcUfcCfcaGfGfaCfgsUfsu | 4051 |
| D-3387 | CfgUfCfcuGfgGfaGfgAfgCfaGfaAfuUf | 3401 | uUfcUfgCfuCfcUfcCfcAfGfgaCfgsUfsu | 4052 |
| D-3388 | CfguCfCfuGfgGfaGfgAfgCfaGfaAfuUf | 3402 | uUfcUfgCfuCfcUfcCfcAfggAfCfgsUfsu | 4053 |
| D-3389 | CfGfucCfuGfgGfaGfgAfgCfaGfaAfuUf | 3403 | uUfcUfgCfuCfcUfcCfcAfgGfAfcgsUfsu | 4054 |
| D-3390 | cGfUfcCfuGfgGfaGfgAfgCfaGfaAfuUf | 3404 | uUfcUfgCfuCfcUfcCfcAfgGfacGfsUfsu | 4055 |
| D-3391 | cgUfcCfuGfgGfaGfgAfgCfaGfaAfuUf | 3405 | uUfcUfgCfuCfcUfcCfcAfgGfaCfGfsusu | 4056 |
| D-3392 | CfgUfcCfuGfgGfaGfgaGfCfaGfaAfuUf | 3406 | uUfcUfgcUfCfcUfcCfcAfgGfaCfgsUfsu | 4057 |
| D-3393 | CfgUfcCfuGfgGfaGfgAfGfcaGfaAfuUf | 3407 | uUfcUfGfcuCfcUfcCfcAfgGfaCfgsUfsu | 4058 |
| D-3394 | CfgUfcCfuGfgGfaGfgAfgcAfGfaAfuUf | 3408 | uUfcuGfCfuCfcUfcCfcAfgGfaCfgsUfsu | 4059 |
| D-3395 | CfgUfcCfuGfgGfaGfgAfgCfAfgaAfuUf | 3409 | uUfCfugCfuCfcUfcCfcAfgGfaCfgsUfsu | 4060 |
| D-3396 | CfgUfcCfuGfgGfaGfgAfgCfagAfAfuUf | 3410 | uuCfUfgCfuCfcUfcCfcAfgGfaCfgsUfsu | 4061 |
| D-3397 | CfgUfcCfuGfgGfaGfgAfgCfaGfAfauUf | 3411 | UfucUfgCfuCfcUfcCfcAfgGfaCfgsUfsu | 4062 |
| D-3398 | CfgUfcCfuGfgGfaGfgAfgCfaGfaaUfUf | 3412 | UfUfcUfgCfuCfcUfcCfcAfgGfaCfgsUfsu | 4063 |
| D-3399 | CfGfucCfUfggGfAfggAfGfcaGfAfauUf | 3413 | UfucUfGfcuCfCfucCfCfagGfAfcgsUfsUf | 4064 |
| D-3400 | cgUfCfcuGfGfgaGfGfagCfAfgaAfUfu | 3414 | uUfCfugCfUfccUfCfccAfGfgaCfGfsusu | 4065 |
| D-3401 | CfguCfCfugGfGfagGfAfgcAfGfaaUfUf | 3415 | UfUfcuGfCfucCfUfccCfAfggAfCfgsusUf | 4066 |
| D-3402 | cGfUfccUfGfggAfGfgaGfCfagAfAfuu | 3416 | uuCfUfgcUfCfcuCfCfcaGfGfacGfsUfsu | 4067 |
| D-3403 | cuGGGGGccucuucuGcuudTsdT | 3417 | AAGcAGAAGAGGCCCCcAGdTsdT | 4068 |
| D-3404 | CfuGfgGfgGfCfCfUfCfuUfcUfgCfuUfuUf | 3418 | aAfgCfaGfaAfgaggcCfcCfcAfgsUfsu | 4069 |
| D-3405 | CfuGfgGfgGfCfcUfCfuUfcUfgCfuUfuUf | 3419 | aAfgCfaGfaAfgaGfgcCfcCfcAfgsUfsu | 4070 |
| D-3406 | CfuGfgGfgGfccUfCfuUfcUfgCfuUfuUf | 3420 | aAfgCfaGfaAfgaGfGfcCfcCfcAfgsUfsu | 4071 |
| D-3407 | CfuGfgGfgGfcCfUfCfUfUfcUfgCfuUfuUf | 3421 | aAfgCfaGfaagagGfcCfcCfcAfgsUfsu | 4072 |
| D-3408 | CfuGfgGfgGfcCfUfcUfUfcUfgCfuUfuUf | 3422 | aAfgCfaGfaaGfagGfcCfcCfcAfgsUfsu | 4073 |
| D-3409 | CfuGfgGfgGfcCfUfcuUfcUfgCfuUfuUf | 3423 | aAfgCfaGfaAfGfagGfcCfcCfcAfgsUfsu | 4074 |
| D-3410 | CfuGfgGfggCfCfuCfuUfcUfgCfuUfuUf | 3424 | aAfgCfaGfaAfgAfggCfCfcCfcAfgsUfsu | 4075 |
| D-3411 | CfuGfgGfgGfcCfuCfUfucUfgCfuUfuUf | 3425 | aAfgCfaGfAfagAfgGfcCfcCfcAfgsUfsu | 4076 |
| D-3412 | CfsusGfgGfggCfCfuCfuUfcUfgCfuUfuUf | 3426 | asAfsgCfaGfaAfgAfggCfCfcCfcAfgsUfsu | 4077 |
| D-3413 | CfuGfgGfggCfCfuCfuUfcUfgCfuUfuUf | 3427 | aAfgCfaGfaAfgAfggCfCfcCfcAfgUfu | 4078 |
| D-3414 | CfsusGfgGfgGfcCfuCfUfucUfgCfuUfuUf | 3428 | asAfsgCfaGfAfagAfgGfcCfcCfcAfgsUfsu | 4079 |
| D-3415 | CfuGfgGfgGfcCfuCfUfucUfgCfuUfuUf | 3429 | aAfgCfaGfAfagAfgGfcCfcCfcAfgUfu | 4080 |
| D-3416 | CfuGfgGfGfgcCfuCfuUfcUfgCfuUfuUf | 3430 | aAfgCfaGfaAfgAfgGfCfccCfcAfgsUfsu | 4081 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3417 | CfuGfggGfGfcCfuCfuUfcUfgCfuUfuUf | 3431 | aAfgCfaGfaAfgAfgGfccCfCfcAfgsUfsu | 4082 |
| D-3418 | CfuGfGfggGfcCfuCfuUfcUfgCfuUfuUf | 3432 | aAfgCfaGfaAfgAfgGfcCfCfccAfgsUfsu | 4083 |
| D-3419 | CfugGfGfgGfcCfuCfuUfcUfgCfuUfuUf | 3433 | aAfgCfaGfaAfgAfgGfcCfccCfAfgsUfsu | 4084 |
| D-3420 | CfUfggGfgGfcCfuCfuUfcUfgCfuUfuUf | 3434 | aAfgCfaGfaAfgAfgGfcCfcCfCfagsUfsu | 4085 |
| D-3421 | cUfGfgGfgGfcCfuCfuUfcUfgCfuUfuUf | 3435 | aAfgCfaGfaAfgAfgGfcCfcCfcaGfsUfsu | 4086 |
| D-3422 | cuGfgGfgGfcCfuCfuUfcUfgCfuUfuUf | 3436 | aAfgCfaGfaAfgAfgGfcCfcCfcAfGfsusu | 4087 |
| D-3423 | CfuGfgGfgGfcCfuCfuuCfUfgCfuUfuUf | 3437 | aAfgCfagAfAfgAfgGfcCfcCfcAfgsUfsu | 4088 |
| D-3424 | CfuGfgGfgGfcCfuCfuUfCfugCfuUfuUf | 3438 | aAfgCfAfgaAfgAfgGfcCfcCfcAfgsUfsu | 4089 |
| D-3425 | CfuGfgGfgGfcCfuCfuUfcuGfCfuUfuUf | 3439 | aAfgcAfGfaAfgAfgGfcCfcCfcAfgsUfsu | 4090 |
| D-3426 | CfuGfgGfgGfcCfuCfuUfcUfGfcuUfuUf | 3440 | aAfGfcaGfaAfgAfgGfcCfcCfcAfgsUfsu | 4091 |
| D-3427 | CfuGfgGfgGfcCfuCfuUfcUfgcUfUfuUf | 3441 | aaGfCfaGfaAfgAfgGfcCfcCfcAfgsUfsu | 4092 |
| D-3428 | CfuGfgGfgGfcCfuCfuUfcUfgCfUfuuUf | 3442 | AfagCfaGfaAfgAfgGfcCfcCfcAfgsUfsu | 4093 |
| D-3429 | CfuGfgGfgGfcCfuCfuUfcUfgCfuuUfUf | 3443 | AfAfgCfaGfaAfgAfgGfcCfcCfcAfgsUfsu | 4094 |
| D-3430 | CfUfggGfGfgcCfUfcuUfCfugCfUfuuUf | 3444 | AfagCfAfgaAfGfagGfCfccCfCfagsUfsUf | 4095 |
| D-3431 | cuGfGfggGfCfcuCfUfucUfGfcuUfUfu | 3445 | aAfGfcaGfAfagAfGfgcCfCfccAfGfsusu | 4096 |
| D-3432 | CfugGfGfggCfCfucUfUfcuGfCfuuUfUf | 3446 | AfAfgcAfGfaaGfAfggCfCfccCfAfgsusUf | 4097 |
| D-3433 | cUfGfggGfGfccUfCfuuCfUfgcUfUfuu | 3447 | aaGfCfagAfAfgaGfGfccCfCfcaGfsUfsu | 4098 |
| D-3434 | ccuAucAuGAccAAGGAGudTsdT | 3448 | ACUCCUUGGUcAUGAuAGGdTsdT | 4099 |
| D-3435 | CfcUfaUfcAfUfGfAfCfcAfaGfgAfgUfuUf | 3449 | aCfuCfcUfuGfgucauGfaUfaGfgsUfsu | 4100 |
| D-3436 | CfcUfaUfcAfUfgAfCfcAfaGfgAfgUfuUf | 3450 | aCfuCfcUfuGfguCfauGfaUfaGfgsUfsu | 4101 |
| D-3437 | CfcUfaUfcAfugAfCfcAfaGfgAfgUfuUf | 3451 | aCfuCfcUfuGfguCfAfuGfaUfaGfgsUfsu | 4102 |
| D-3438 | CfcUfaUfcAfuGfAfCfCfAfaGfgAfgUfuUf | 3452 | aCfuCfcUfuggucAfuGfaUfaGfgsUfsu | 4103 |
| D-3439 | CfcUfaUfcAfuGfAfcCfAfaGfgAfgUfuUf | 3453 | aCfuCfcUfugGfucAfuGfaUfaGfgsUfsu | 4104 |
| D-3440 | CfcUfaUfcAfuGfAfccAfaGfgAfgUfuUf | 3454 | aCfuCfcUfuGfGfucAfuGfaUfaGfgsUfsu | 4105 |
| D-3441 | CfcUfaUfcaUfGfaCfcAfaGfgAfgUfuUf | 3455 | aCfuCfcUfuGfgUfcaUfGfaUfaGfgsUfsu | 4106 |
| D-3442 | CfcUfaUfcAfuGfaCfCfaaGfgAfgUfuUf | 3456 | aCfuCfcUfUfggUfcAfuGfaUfaGfgsUfsu | 4107 |
| D-3443 | CfscsUfaUfcaUfGfaCfcAfaGfgAfgUfuUf | 3457 | asCfsuCfcUfuGfgUfcaUfGfaUfaGfgsUfsu | 4108 |
| D-3444 | CfcUfaUfcaUfGfaCfcAfaGfgAfgUfuUf | 3458 | aCfuCfcUfuGfgUfcaUfGfaUfaGfgUfu | 4109 |
| D-3445 | CfscsUfaUfcAfuGfaCfCfaaGfgAfgUfuUf | 3459 | asCfsuCfcUfUfggUfcAfuGfaUfaGfgsUfsu | 4110 |
| D-3446 | CfcUfaUfcAfuGfaCfCfaaGfgAfgUfuUf | 3460 | aCfuCfcUfUfggUfcAfuGfaUfaGfgUfu | 4111 |
| D-3447 | CfcUfaUfCfauGfaCfcAfaGfgAfgUfuUf | 3461 | aCfuCfcUfuGfgUfcAfUfgaUfaGfgsUfsu | 4112 |
| D-3448 | CfcUfauCfAfuGfaCfcAfaGfgAfgUfuUf | 3462 | aCfuCfcUfuGfgUfcAfugAfUfaGfgsUfsu | 4113 |
| D-3449 | CfcUfAfucAfuGfaCfcAfaGfgAfgUfuUf | 3463 | aCfuCfcUfuGfgUfcAfuGfAfuaGfgsUfsu | 4114 |
| D-3450 | CfcuAfUfcAfuGfaCfcAfaGfgAfgUfuUf | 3464 | aCfuCfcUfuGfgUfcAfuGfauAfGfgsUfsu | 4115 |
| D-3451 | CfCfuaUfcAfuGfaCfcAfaGfgAfgUfuUf | 3465 | aCfuCfcUfuGfgUfcAfuGfaUfAfggsUfsu | 4116 |
| D-3452 | cCfUfaUfcAfuGfaCfcAfaGfgAfgUfuUf | 3466 | aCfuCfcUfuGfgUfcAfuGfaUfagGfsUfsu | 4117 |
| D-3453 | ccUfaUfcAfuGfaCfcAfaGfgAfgUfuUf | 3467 | aCfuCfcUfuGfgUfcAfuGfaUfaGfGfsusu | 4118 |
| D-3454 | CfcUfaUfcAfuGfaCfcaAfGfgAfgUfuUf | 3468 | aCfuCfcuUfGfgUfcAfuGfaUfaGfgsUfsu | 4119 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3455 | CfcUfaUfcAfuGfaCfcAfAfggAfgUfuUf | 3469 | aCfuCfCfuuGfgUfcAfuGfaUfaGfgsUfsu | 4120 |
| D-3456 | CfcUfaUfcAfuGfaCfcAfagGfAfgUfuUf | 3470 | aCfucCfUfuGfgUfcAfuGfaUfaGfgsUfsu | 4121 |
| D-3457 | CfcUfaUfcAfuGfaCfcAfaGfGfagUfuUf | 3471 | aCfUfccUfuGfgUfcAfuGfaUfaGfgsUfsu | 4122 |
| D-3458 | CfcUfaUfcAfuGfaCfcAfaGfgaGfUfuUf | 3472 | acUfCfcUfuGfgUfcAfuGfaUfaGfgsUfsu | 4123 |
| D-3459 | CfcUfaUfcAfuGfaCfcAfaGfgAfGfuuUf | 3473 | AfcuCfcUfuGfgUfcAfuGfaUfaGfgsUfsu | 4124 |
| D-3460 | CfcUfaUfcAfuGfaCfcAfaGfgAfguUfUf | 3474 | AfCfuCfcUfuGfgUfcAfuGfaUfaGfgsUfsu | 4125 |
| D-3461 | CfCfuaUfCfauGfAfccAfAfggAfGfuuUf | 3475 | AfcuCfCfuuGfGfucAfUfgaUfAfggsUfsUf | 4126 |
| D-3462 | ccUfAfucAfUfgaCfCfaaGfGfagUfUfu | 3476 | aCfUfccUfUfggUfCfauGfAfuaGfGfsusu | 4127 |
| D-3463 | CfcuAfUfcaUfGfacCfAfagGfAfguUfUf | 3477 | AfCfucCfUfugGfUfcaUfGfauAfGfgsusUf | 4128 |
| D-3464 | cCfUfauCfAfugAfCfcaAfGfgaGfUfuu | 3478 | acUfCfcuUfGfguCfAfugAfUfagGfsUfsu | 4129 |
| D-3465 | uGuGGGAAGAAAGAuGAAGdTsdT | 3479 | CUUcAUCUUUCUUCCcAcAdTsdT | 4130 |
| D-3466 | UfgUfgGfgAfAfGfAfAfaGfaUfgAfaGfuUf | 3480 | cUfuCfaUfcUfuucuuCfcCfaCfasUfsu | 4131 |
| D-3467 | UfgUfgGfgAfAfgAfAfaGfaUfgAfaGfuUf | 3481 | cUfuCfaUfcUfuuCfuuCfcCfaCfasUfsu | 4132 |
| D-3468 | UfgUfgGfgAfagAfAfaGfaUfgAfaGfuUf | 3482 | cUfuCfaUfcUfuuCfUfuCfcCfaCfasUfsu | 4133 |
| D-3469 | UfgUfgGfgAfaGfAfAfAfGfaUfgAfaGfuUf | 3483 | cUfuCfaUfcuuucUfuCfcCfaCfasUfsu | 4134 |
| D-3470 | UfgUfgGfgAfaGfAfaAfGfaUfgAfaGfuUf | 3484 | cUfuCfaUfcuUfucUfuCfcCfaCfasUfsu | 4135 |
| D-3471 | UfgUfgGfgAfaGfAfaaGfaUfgAfaGfuUf | 3485 | cUfuCfaUfcUfUfucUfuCfcCfaCfasUfsu | 4136 |
| D-3472 | UfgUfgGfgaAfGfaAfaGfaUfgAfaGfuUf | 3486 | cUfuCfaUfcUfuUfcuUfCfcCfaCfasUfsu | 4137 |
| D-3473 | UfgUfgGfgAfaGfaAfAfgaUfgAfaGfuUf | 3487 | cUfuCfaUfCfuuUfcUfuCfcCfaCfasUfsu | 4138 |
| D-3474 | UfsgsUfgGfgaAfGfaAfaGfaUfgAfaGfuUf | 3488 | csUfsuCfaUfcUfuUfcuUfCfcCfaCfasUfsu | 4139 |
| D-3475 | UfgUfgGfgaAfGfaAfaGfaUfgAfaGfuUf | 3489 | cUfuCfaUfcUfuUfcuUfCfcCfaCfaUfu | 4140 |
| D-3476 | UfsgsUfgGfgAfaGfaAfAfgaUfgAfaGfuUf | 3490 | csUfsuCfaUfCfuuUfcUfuCfcCfaCfasUfsu | 4141 |
| D-3477 | UfgUfgGfgAfaGfaAfAfgaUfgAfaGfuUf | 3491 | cUfuCfaUfCfuuUfcUfuCfcCfaCfaUfu | 4142 |
| D-3478 | UfgUfgGfGfaaGfaAfaGfaUfgAfaGfuUf | 3492 | cUfuCfaUfcUfuUfcUfUfccCfaCfasUfsu | 4143 |
| D-3479 | UfgUfggGfAfaGfaAfaGfaUfgAfaGfuUf | 3493 | cUfuCfaUfcUfuUfcUfucCfCfaCfasUfsu | 4144 |
| D-3480 | UfgUfGfggAfaGfaAfaGfaUfgAfaGfuUf | 3494 | cUfuCfaUfcUfuUfcUfuCfCfcaCfasUfsu | 4145 |
| D-3481 | UfguGfGfgAfaGfaAfaGfaUfgAfaGfuUf | 3495 | cUfuCfaUfcUfuUfcUfuCfccAfCfasUfsu | 4146 |
| D-3482 | UfGfugGfgAfaGfaAfaGfaUfgAfaGfuUf | 3496 | cUfuCfaUfcUfuUfcUfuCfcCfAfcasUfsu | 4147 |
| D-3483 | uGfUfgGfgAfaGfaAfaGfaUfgAfaGfuUf | 3497 | cUfuCfaUfcUfuUfcUfuCfcCfacAfsUfsu | 4148 |
| D-3484 | ugUfgGfgAfaGfaAfaGfaUfgAfaGfuUf | 3498 | cUfuCfaUfcUfuUfcUfuCfcCfaCfAfsusu | 4149 |
| D-3485 | UfgUfgGfgAfaGfaAfagAfUfgAfaGfuUf | 3499 | cUfuCfauCfUfuUfcUfuCfcCfaCfasUfsu | 4150 |
| D-3486 | UfgUfgGfgAfaGfaAfaGfAfugAfaGfuUf | 3500 | cUfuCfAfucUfuUfcUfuCfcCfaCfasUfsu | 4151 |
| D-3487 | UfgUfgGfgAfaGfaAfaGfauGfAfaGfuUf | 3501 | cUfucAfUfcUfuUfcUfuCfcCfaCfasUfsu | 4152 |
| D-3488 | UfgUfgGfgAfaGfaAfaGfaUfGfaaGfuUf | 3502 | cUfUfcaUfcUfuUfcUfuCfcCfaCfasUfsu | 4153 |
| D-3489 | UfgUfgGfgAfaGfaAfaGfaUfgaAfGfuUf | 3503 | cuUfCfaUfcUfuUfcUfuCfcCfaCfasUfsu | 4154 |
| D-3490 | UfgUfgGfgAfaGfaAfaGfaUfgAfAfguUf | 3504 | CfuuCfaUfcUfuUfcUfuCfcCfaCfasUfsu | 4155 |
| D-3491 | UfgUfgGfgAfaGfaAfaGfaUfgAfagUfUf | 3505 | CfUfuCfaUfcUfuUfcUfuCfcCfaCfasUfsu | 4156 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3492 | UfGfugGfGfaaGfAfaaGfAfugAfAfguUf | 3506 | CfuuCfAfucUfUfucUfUfccCfAfcasUfsUf | 4157 |
| D-3493 | ugUfGfggAfAfgaAfAfgaUfGfaaGfUfu | 3507 | cUfUfcaUfCfuuUfCfuuCfCfcaCfAfsusu | 4158 |
| D-3494 | UfguGfGfgaAfGfaaAfGfauGfAfagUfUf | 3508 | CfUfucAfUfcuUfUfcuUfCfccAfCfasusUf | 4159 |
| D-3495 | uGfUfggGfAfagAfAfagAfUfgaAfGfuu | 3509 | cuUfCfauCfUfuuCfUfucCfCfacAfsUfsu | 4160 |
| D-3496 | AGGAcuGuGcccAcuucAcdTsdT | 3510 | GUGAAGUGGGcAcAGUCCUdTsdT | 4161 |
| D-3497 | AfgGfaCfuGfUfGfCfCfcAfcUfuCfaCfuUf | 3511 | gUfgAfaGfuGfggcacAfgUfcCfusUfsu | 4162 |
| D-3498 | AfgGfaCfuGfUfgCfCfcAfcUfuCfaCfuUf | 3512 | gUfgAfaGfuGfggCfacAfgUfcCfusUfsu | 4163 |
| D-3499 | AfgGfaCfuGfugCfCfcAfcUfuCfaCfuUf | 3513 | gUfgAfaGfuGfggCfAfcAfgUfcCfusUfsu | 4164 |
| D-3500 | AfgGfaCfuGfuGfCfCfCfAfcUfuCfaCfuUf | 3514 | gUfgAfaGfugggcAfcAfgUfcCfusUfsu | 4165 |
| D-3501 | AfgGfaCfuGfuGfCfcCfAfcUfuCfaCfuUf | 3515 | gUfgAfaGfugGfgcAfcAfgUfcCfusUfsu | 4166 |
| D-3502 | AfgGfaCfuGfuGfCfccAfcUfuCfaCfuUf | 3516 | gUfgAfaGfuGfGfgcAfcAfgUfcCfusUfsu | 4167 |
| D-3503 | AfgGfaCfugUfGfcCfcAfcUfuCfaCfuUf | 3517 | gUfgAfaGfuGfgGfcaCfAfgUfcCfusUfsu | 4168 |
| D-3504 | AfgGfaCfuGfuGfcCfCfacUfuCfaCfuUf | 3518 | gUfgAfaGfUfggGfcAfcAfgUfcCfusUfsu | 4169 |
| D-3505 | AfsgsGfaCfugUfGfcCfcAfcUfuCfaCfuUf | 3519 | gsUfsgAfaGfuGfgGfcaCfAfgUfcCfusUfsu | 4170 |
| D-3506 | AfgGfaCfugUfGfcCfcAfcUfuCfaCfuUf | 3520 | gUfgAfaGfuGfgGfcaCfAfgUfcCfuUfu | 4171 |
| D-3507 | AfsgsGfaCfuGfuGfcCfCfacUfuCfaCfuUf | 3521 | gsUfsgAfaGfUfggGfcAfcAfgUfcCfusUfsu | 4172 |
| D-3508 | AfgGfaCfuGfuGfcCfCfacUfuCfaCfuUf | 3522 | gUfgAfaGfUfggGfcAfcAfgUfcCfuUfu | 4173 |
| D-3509 | AfgGfaCfUfguGfcCfcAfcUfuCfaCfuUf | 3523 | gUfgAfaGfuGfgGfcAfCfagUfcCfusUfsu | 4174 |
| D-3510 | AfgGfacUfGfuGfcCfcAfcUfuCfaCfuUf | 3524 | gUfgAfaGfuGfgGfcAfcaGfUfcCfusUfsu | 4175 |
| D-3511 | AfgGfAfcuGfuGfcCfcAfcUfuCfaCfuUf | 3525 | gUfgAfaGfuGfgGfcAfcAfGfucCfusUfsu | 4176 |
| D-3512 | AfggAfCfuGfuGfcCfcAfcUfuCfaCfuUf | 3526 | gUfgAfaGfuGfgGfcAfcAfguCfCfusUfsu | 4177 |
| D-3513 | AfGfgaCfuGfuGfcCfcAfcUfuCfaCfuUf | 3527 | gUfgAfaGfuGfgGfcAfcAfgUfCfcusUfsu | 4178 |
| D-3514 | aGfGfaCfuGfuGfcCfcAfcUfuCfaCfuUf | 3528 | gUfgAfaGfuGfgGfcAfcAfgUfccUfsUfsu | 4179 |
| D-3515 | agGfaCfuGfuGfcCfcAfcUfuCfaCfuUf | 3529 | gUfgAfaGfuGfgGfcAfcAfgUfcCfUfsusu | 4180 |
| D-3516 | AfgGfaCfuGfuGfcCfcaCfUfuCfaCfuUf | 3530 | gUfgAfagUfGfgGfcAfcAfgUfcCfusUfsu | 4181 |
| D-3517 | AfgGfaCfuGfuGfcCfcAfCfuuCfaCfuUf | 3531 | gUfgAfAfguGfgGfcAfcAfgUfcCfusUfsu | 4182 |
| D-3518 | AfgGfaCfuGfuGfcCfcAfcuUfCfaCfuUf | 3532 | gUfgaAfGfuGfgGfcAfcAfgUfcCfusUfsu | 4183 |
| D-3519 | AfgGfaCfuGfuGfcCfcAfcUfUfcaCfuUf | 3533 | gUfGfaaGfuGfgGfcAfcAfgUfcCfusUfsu | 4184 |
| D-3520 | AfgGfaCfuGfuGfcCfcAfcUfucAfCfuUf | 3534 | guGfAfaGfuGfgGfcAfcAfgUfcCfusUfsu | 4185 |
| D-3521 | AfgGfaCfuGfuGfcCfcAfcUfuCfAfcuUf | 3535 | GfugAfaGfuGfgGfcAfcAfgUfcCfusUfsu | 4186 |
| D-3522 | AfgGfaCfuGfuGfcCfcAfcUfuCfacUfUf | 3536 | GfUfgAfaGfuGfgGfcAfcAfgUfcCfusUfsu | 4187 |
| D-3523 | AfGfgaCfUfguGfCfccAfCfuuCfAfcuUf | 3537 | GfugAfAfguGfGfgcAfCfagUfCfcusUfsUf | 4188 |
| D-3524 | agGfAfcuGfUfgcCfCfacUfUfcaCfUfu | 3538 | gUfGfaaGfUfggGfCfacAfGfucCfUfsusu | 4189 |
| D-3525 | AfggAfCfugUfGfccCfAfcuUfCfacUfUf | 3539 | GfUfgaAfGfugGfGfcaCfAfguCfCfususUf | 4190 |
| D-3526 | aGfGfacUfGfugCfCfcaCfUfucAfCfuu | 3540 | guGfAfagUfGfggCfAfcaGfUfccUfsUfsu | 4191 |
| D-3527 | GAuAGGGuGAuGuuccGAAdTsdT | 3541 | UUCGGAAcAUcACCCuAUCdTsdT | 4192 |
| D-3528 | GfaUfaGfgGfUfGfAfUfgUfuCfcGfaAfuUf | 3542 | uUfcGfgAfaCfaucacCfcUfaUfcsUfsu | 4193 |
| D-3529 | GfaUfaGfgGfUfgAfUfgUfuCfcGfaAfuUf | 3543 | uUfcGfgAfaCfauCfacCfcUfaUfcsUfsu | 4194 |

TABLE 6-continued

| ASGR1 chemically modified siRNA Sequences | | | | |
|---|---|---|---|---|
| Duplex No. | Sense Sequence (5'-3') | SEQ ID NO: (sense) | Antisense Sequence (5'-3') | SEQ ID NO: (antisense) |
| D-3530 | GfaUfaGfgGfugAfUfgUfuCfcGfaAfuUf | 3544 | uUfcGfgAfaCfauCfAfcCfcUfaUfcsUfsu | 4195 |
| D-3531 | GfaUfaGfgGfuGfAfUfGfUfuCfcGfaAfuUf | 3545 | uUfcGfgAfacaucAfcCfcUfaUfcsUfsu | 4196 |
| D-3532 | GfaUfaGfgGfuGfAfuGfUfuCfcGfaAfuUf | 3546 | uUfcGfgAfacAfucAfcCfcUfaUfcsUfsu | 4197 |
| D-3533 | GfaUfaGfgGfuGfAfugUfuCfcGfaAfuUf | 3547 | uUfcGfgAfaCfAfucAfcCfcUfaUfcsUfsu | 4198 |
| D-3534 | GfaUfaGfggUfGfaUfgUfuCfcGfaAfuUf | 3548 | uUfcGfgAfaCfaUfcaCfCfcUfaUfcsUfsu | 4199 |
| D-3535 | GfaUfaGfgGfuGfaUfGfuuCfcGfaAfuUf | 3549 | uUfcGfgAfAfcaUfcAfcCfcUfaUfcsUfsu | 4200 |
| D-3536 | GfsasUfaGfggUfGfaUfgUfuCfcGfaAfuUf | 3550 | usUfscGfgAfaCfaUfcaCfCfcUfaUfcsUfsu | 4201 |
| D-3537 | GfaUfaGfggUfGfaUfgUfuCfcGfaAfuUf | 3551 | uUfcGfgAfaCfaUfcaCfCfcUfaUfcUfu | 4202 |
| D-3538 | GfsasUfaGfgGfuGfaUfGfuuCfcGfaAfuUf | 3552 | usUfscGfgAfAfcaUfcAfcCfcUfaUfcsUfsu | 4203 |
| D-3539 | GfaUfaGfgGfuGfaUfGfuuCfcGfaAfuUf | 3553 | uUfcGfgAfAfcaUfcAfcCfcUfaUfcUfu | 4204 |
| D-3540 | GfaUfaGfGfguGfaUfgUfuCfcGfaAfuUf | 3554 | uUfcGfgAfaCfaUfcAfCfccUfaUfcsUfsu | 4205 |
| D-3541 | GfaUfagGfGfuGfaUfgUfuCfcGfaAfuUf | 3555 | uUfcGfgAfaCfaUfcAfccCfUfaUfcsUfsu | 4206 |
| D-3542 | GfaUfAfggGfuGfaUfgUfuCfcGfaAfuUf | 3556 | uUfcGfgAfaCfaUfcAfcCfCfuaUfcsUfsu | 4207 |
| D-3543 | GfauAfGfgGfuGfaUfgUfuCfcGfaAfuUf | 3557 | uUfcGfgAfaCfaUfcAfcCfcuAfUfcsUfsu | 4208 |
| D-3544 | GfAfuaGfgGfuGfaUfgUfuCfcGfaAfuUf | 3558 | uUfcGfgAfaCfaUfcAfcCfcUfAfucsUfsu | 4209 |
| D-3545 | gAfUfaGfgGfuGfaUfgUfuCfcGfaAfuUf | 3559 | uUfcGfgAfaCfaUfcAfcCfcUfauCfsUfsu | 4210 |
| D-3546 | gaUfaGfgGfuGfaUfgUfuCfcGfaAfuUf | 3560 | uUfcGfgAfaCfaUfcAfcCfcUfaUfCfsusu | 4211 |
| D-3547 | GfaUfaGfgGfuGfaUfguUfCfcGfaAfuUf | 3561 | uUfcGfgaAfCfaUfcAfcCfcUfaUfcsUfsu | 4212 |
| D-3548 | GfaUfaGfgGfuGfaUfgUfUfccGfaAfuUf | 3562 | uUfcGfGfaaCfaUfcAfcCfcUfaUfcsUfsu | 4213 |
| D-3549 | GfaUfaGfgGfuGfaUfgUfucCfGfaAfuUf | 3563 | uUfcgGfAfaCfaUfcAfcCfcUfaUfcsUfsu | 4214 |
| D-3550 | GfaUfaGfgGfuGfaUfgUfuCfCfgaAfuUf | 3564 | uUfCfggAfaCfaUfcAfcCfcUfaUfcsUfsu | 4215 |
| D-3551 | GfaUfaGfgGfuGfaUfgUfuCfcgAfAfuUf | 3565 | uuCfGfgAfaCfaUfcAfcCfcUfaUfcsUfsu | 4216 |
| D-3552 | GfaUfaGfgGfuGfaUfgUfuCfcGfAfauUf | 3566 | UfucGfgAfaCfaUfcAfcCfcUfaUfcsUfsu | 4217 |
| D-3553 | GfaUfaGfgGfuGfaUfgUfuCfcGfaaUfUf | 3567 | UfUfcGfgAfaCfaUfcAfcCfcUfaUfcsUfsu | 4218 |
| D-3554 | GfAfuaGfGfguGfAfugUfUfccGfAfauUf | 3568 | UfucGfGfaaCfAfucAfCfccUfAfucsUfsUf | 4219 |
| D-3555 | gaUfAfggGfUfgaUfGfuuCfCfgaAfUfu | 3569 | uUfCfggAfAfcaUfCfacCfCfuaUfCfsusu | 4220 |
| D-3556 | GfauAfGfggUfGfauGfUfucCfGfaaUfUf | 3570 | UfUfcgGfAfacAfUfcaCfCfcuAfUfcsusUf | 4221 |
| D-3557 | gAfUfagGfGfugAfUfguUfCfcgAfAfuu | 3571 | uuCfGfgaAfCfauCfAfccCfUfauCfsUfsu | 4222 |
| D-3558 | GcAGuuuGcAGGuuAucAudTsdT | 3572 | AUGAuAACCUGcAAACUGCdTsdT | 4223 |
| D-3559 | GfcAfgUfuUfGfCfAfGfgUfuAfuCfaUfuUf | 3573 | aUfgAfuAfaCfcugcaAfaCfuGfcsUfsu | 4224 |
| D-3560 | GfcAfgUfuUfGfcAfGfgUfuAfuCfaUfuUf | 3574 | aUfgAfuAfaCfcuGfcaAfaCfuGfcsUfsu | 4225 |
| D-3561 | GfcAfgUfuUfgcAfGfgUfuAfuCfaUfuUf | 3575 | aUfgAfuAfaCfcuGfCfaAfaCfuGfcsUfsu | 4226 |
| D-3562 | GfcAfgUfuUfgCfAfGfGfUfuAfuCfaUfuUf | 3576 | aUfgAfuAfaccugCfaAfaCfuGfcsUfsu | 4227 |
| D-3563 | GfcAfgUfuUfgCfAfgGfUfuAfuCfaUfuUf | 3577 | aUfgAfuAfacCfugCfaAfaCfuGfcsUfsu | 4228 |
| D-3564 | GfcAfgUfuUfgCfAfggUfuAfuCfaUfuUf | 3578 | aUfgAfuAfaCfCfugCfaAfaCfuGfcsUfsu | 4229 |
| D-3565 | GfcAfgUfuuGfCfaGfgUfuAfuCfaUfuUf | 3579 | aUfgAfuAfaCfcUfgcAfAfaCfuGfcsUfsu | 4230 |
| D-3566 | GfcAfgUfuUfgCfaGfGfuuAfuCfaUfuUf | 3580 | aUfgAfuAfAfccUfgCfaAfaCfuGfcsUfsu | 4231 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3567 | GfscsAfgUfuuGfCfaGfgUfuAfuCfaUfuUf | 3581 | asUfsgAfuAfaCfcUfgcAfAfaCfuGfcsUfsu | 4232 |
| D-3568 | GfcAfgUfuuGfCfaGfgUfuAfuCfaUfuUf | 3582 | aUfgAfuAfaCfcUfgcAfAfaCfuGfcUfu | 4233 |
| D-3569 | GfscsAfgUfuUfgCfaGfGfuuAfuCfaUfuUf | 3583 | asUfsgAfuAfAfccUfgCfaAfaCfuGfcsUfsu | 4234 |
| D-3570 | GfcAfgUfuUfgCfaGfGfuuAfuCfaUfuUf | 3584 | aUfgAfuAfAfccUfgCfaAfaCfuGfcUfu | 4235 |
| D-3571 | GfcAfgUfUfugCfaGfgUfuAfuCfaUfuUf | 3585 | aUfgAfuAfaCfcUfgCfAfaaCfuGfcsUfsu | 4236 |
| D-3572 | GfcAfguUfUfgCfaGfgUfuAfuCfaUfuUf | 3586 | aUfgAfuAfaCfcUfgCfaaAfCfuGfcsUfsu | 4237 |
| D-3573 | GfcAfGfuuUfgCfaGfgUfuAfuCfaUfuUf | 3587 | aUfgAfuAfaCfcUfgCfaAfAfcuGfcsUfsu | 4238 |
| D-3574 | GfcaGfUfuUfgCfaGfgUfuAfuCfaUfuUf | 3588 | aUfgAfuAfaCfcUfgCfaAfacUfGfcsUfsu | 4239 |
| D-3575 | GfCfagUfuUfgCfaGfgUfuAfuCfaUfuUf | 3589 | aUfgAfuAfaCfcUfgCfaAfaCfUfgcsUfsu | 4240 |
| D-3576 | gCfAfgUfuUfgCfaGfgUfuAfuCfaUfuUf | 3590 | aUfgAfuAfaCfcUfgCfaAfaCfugCfsUfsu | 4241 |
| D-3577 | gcAfgUfuUfgCfaGfgUfuAfuCfaUfuUf | 3591 | aUfgAfuAfaCfcUfgCfaAfaCfuGfCfsusu | 4242 |
| D-3578 | GfcAfgUfuUfgCfaGfguUfAfuCfaUfuUf | 3592 | aUfgAfuaAfCfcUfgCfaAfaCfuGfcsUfsu | 4243 |
| D-3579 | GfcAfgUfuUfgCfaGfgUfUfauCfaUfuUf | 3593 | aUfgAfUfaaCfcUfgCfaAfaCfuGfcsUfsu | 4244 |
| D-3580 | GfcAfgUfuUfgCfaGfgUfuaUfCfaUfuUf | 3594 | aUfgaUfAfaCfcUfgCfaAfaCfuGfcsUfsu | 4245 |
| D-3581 | GfcAfgUfuUfgCfaGfgUfuAfUfcaUfuUf | 3595 | aUfGfauAfaCfcUfgCfaAfaCfuGfcsUfsu | 4246 |
| D-3582 | GfcAfgUfuUfgCfaGfgUfuAfucAfUfuUf | 3596 | auGfAfuAfaCfcUfgCfaAfaCfuGfcsUfsu | 4247 |
| D-3583 | GfcAfgUfuUfgCfaGfgUfuAfuCfAfuuUf | 3597 | AfugAfuAfaCfcUfgCfaAfaCfuGfcsUfsu | 4248 |
| D-3584 | GfcAfgUfuUfgCfaGfgUfuAfuCfauUfUf | 3598 | AfUfgAfuAfaCfcUfgCfaAfaCfuGfcsUfsu | 4249 |
| D-3585 | GfCfagUfUfugCfAfggUfUfauCfAfuuUf | 3599 | AfugAfUfaaCfCfugCfAfaaCfUfgcsUfsUf | 4250 |
| D-3586 | gcAfGfuuUfGfcaGfGfuuAfUfcaUfUfu | 3600 | aUfGfauAfAfccUfGfcaAfAfcuGfCfsusu | 4251 |
| D-3587 | GfcaGfUfuuGfCfagGfUfuaUfCfauUfUf | 3601 | AfUfgaUfAfacCfUfgcAfAfacUfGfcsusUf | 4252 |
| D-3588 | gCfAfguUfUfgcAfGfguUfAfucAfUfuu | 3602 | auGfAfuaAfCfcuGfCfaaAfCfugCfsUfsu | 4253 |
| D-3589 | GGuuGucuGuGuGAucGGAdTsdT | 3603 | UCCGAUcAcAcAGAcAACCdTsdT | 4254 |
| D-3590 | GfgUfuGfuCfUfGfUfGfuGfaUfcGfgAfuUf | 3604 | uCfcGfaUfcAfcacagAfcAfaCfcsUfsu | 4255 |
| D-3591 | GfgUfuGfuCfUfgUfGfuGfaUfcGfgAfuUf | 3605 | uCfcGfaUfcAfcaCfagAfcAfaCfcsUfsu | 4256 |
| D-3592 | GfgUfuGfuCfugUfGfuGfaUfcGfgAfuUf | 3606 | uCfcGfaUfcAfcaCfAfgAfcAfaCfcsUfsu | 4257 |
| D-3593 | GfgUfuGfuCfuGfUfGfUfGfaUfcGfgAfuUf | 3607 | uCfcGfaUfcacacAfgAfcAfaCfcsUfsu | 4258 |
| D-3594 | GfgUfuGfuCfuGfUfgUfGfaUfcGfgAfuUf | 3608 | uCfcGfaUfcaCfacAfgAfcAfaCfcsUfsu | 4259 |
| D-3595 | GfgUfuGfuCfuGfUfguGfaUfcGfgAfuUf | 3609 | uCfcGfaUfcAfCfacAfgAfcAfaCfcsUfsu | 4260 |
| D-3596 | GfgUfuGfucUfGfuGfuGfaUfcGfgAfuUf | 3610 | uCfcGfaUfcAfcAfcaGfAfcAfaCfcsUfsu | 4261 |
| D-3597 | GfgUfuGfuCfuGfuGfUfgaUfcGfgAfuUf | 3611 | uCfcGfaUfCfacAfcAfgAfcAfaCfcsUfsu | 4262 |
| D-3598 | GfsgsUfuGfucUfGfuGfuGfaUfcGfgAfuUf | 3612 | usCfscGfaUfcAfcAfcaGfAfcAfaCfcsUfsu | 4263 |
| D-3599 | GfgUfuGfucUfGfuGfuGfaUfcGfgAfuUf | 3613 | uCfcGfaUfcAfcAfcaGfAfcAfaCfcUfu | 4264 |
| D-3600 | GfsgsUfuGfuCfuGfuGfUfgaUfcGfgAfuUf | 3614 | usCfscGfaUfCfacAfcAfgAfcAfaCfcsUfsu | 4265 |
| D-3601 | GfgUfuGfuCfuGfuGfUfgaUfcGfgAfuUf | 3615 | uCfcGfaUfCfacAfcAfgAfcAfaCfcUfu | 4266 |
| D-3602 | GfgUfuGfUfcuGfuGfuGfaUfcGfgAfuUf | 3616 | uCfcGfaUfcAfcAfcAfGfacAfaCfcsUfsu | 4267 |
| D-3603 | GfgUfugUfCfuGfuGfuGfaUfcGfgAfuUf | 3617 | uCfcGfaUfcAfcAfcAfgaCfAfaCfcsUfsu | 4268 |
| D-3604 | GfgUfUfguCfuGfuGfuGfaUfcGfgAfuUf | 3618 | uCfcGfaUfcAfcAfcAfgAfCfaaCfcsUfsu | 4269 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3605 | GfguUfGfuCfuGfuGfuGfaUfcGfgAfuUf | 3619 | uCfcGfaUfcAfcAfcAfgAfcaAfCfcsUfsu | 4270 |
| D-3606 | GfGfuuGfuCfuGfuGfuGfaUfcGfgAfuUf | 3620 | uCfcGfaUfcAfcAfcAfgAfcAfAfccsUfsu | 4271 |
| D-3607 | gGfUfuGfuCfuGfuGfuGfaUfcGfgAfuUf | 3621 | uCfcGfaUfcAfcAfcAfgAfcAfacCfsUfsu | 4272 |
| D-3608 | ggUfuGfuCfuGfuGfuGfaUfcGfgAfuUf | 3622 | uCfcGfaUfcAfcAfcAfgAfcAfaCfCfsusu | 4273 |
| D-3609 | GfgUfuGfuCfuGfuGfugAfUfcGfgAfuUf | 3623 | uCfcGfauCfAfcAfcAfgAfcAfaCfcsUfsu | 4274 |
| D-3610 | GfgUfuGfuCfuGfuGfuGfAfucGfgAfuUf | 3624 | uCfcGfAfucAfcAfcAfgAfcAfaCfcsUfsu | 4275 |
| D-3611 | GfgUfuGfuCfuGfuGfuGfauCfGfgAfuUf | 3625 | uCfcgAfUfcAfcAfcAfgAfcAfaCfcsUfsu | 4276 |
| D-3612 | GfgUfuGfuCfuGfuGfuGfaUfCfggAfuUf | 3626 | uCfCfgaUfcAfcAfcAfgAfcAfaCfcsUfsu | 4277 |
| D-3613 | GfgUfuGfuCfuGfuGfuGfaUfcgGfAfuUf | 3627 | ucCfGfaUfcAfcAfcAfgAfcAfaCfcsUfsu | 4278 |
| D-3614 | GfgUfuGfuCfuGfuGfuGfaUfcGfGfauUf | 3628 | UfccGfaUfcAfcAfcAfgAfcAfaCfcsUfsu | 4279 |
| D-3615 | GfgUfuGfuCfuGfuGfuGfaUfcGfgaUfUf | 3629 | UfCfcGfaUfcAfcAfcAfgAfcAfaCfcsUfsu | 4280 |
| D-3616 | GfGfuuGfUfcuGfUfguGfAfucGfGfauUf | 3630 | UfccGfAfucAfCfacAfGfacAfAfccsUfsUf | 4281 |
| D-3617 | ggUfUfguCfUfguGfUfgaUfCfggAfUfu | 3631 | uCfCfgaUfCfacAfCfagAfCfaaCfCfsusu | 4282 |
| D-3618 | GfguUfGfucUfGfugUfGfauCfGfgaUfUf | 3632 | UfCfcgAfUfcaCfAfcaGfAfcaAfCfcsusUf | 4283 |
| D-3619 | gGfUfugUfCfugUfGfugAfUfcgGfAfuu | 3633 | ucCfGfauCfAfcaCfAfgaCfAfacCfsUfsu | 4284 |
| D-3620 | cGGAcuAcGAGAcGGGcuudTsdT | 3634 | AAGCCCGUCUCGuAGUCCGdTsdT | 4285 |
| D-3621 | CfgGfaCfuAfCfGfAfGfaCfgGfgCfuUfuUf | 3635 | aAfgCfcCfgUfcucguAfgUfcCfgsUfsu | 4286 |
| D-3622 | CfgGfaCfuAfCfgAfGfaCfgGfgCfuUfuUf | 3636 | aAfgCfcCfgUfcuCfguAfgUfcCfgsUfsu | 4287 |
| D-3623 | CfgGfaCfuAfcgAfGfaCfgGfgCfuUfuUf | 3637 | aAfgCfcCfgUfcuCfGfuAfgUfcCfgsUfsu | 4288 |
| D-3624 | CfgGfaCfuAfcGfAfGfAfCfgGfgCfuUfuUf | 3638 | aAfgCfcCfgucucGfuAfgUfcCfgsUfsu | 4289 |
| D-3625 | CfgGfaCfuAfcGfAfgAfCfgGfgCfuUfuUf | 3639 | aAfgCfcCfguCfucGfuAfgUfcCfgsUfsu | 4290 |
| D-3626 | CfgGfaCfuAfcGfAfgaCfgGfgCfuUfuUf | 3640 | aAfgCfcCfgUfCfucGfuAfgUfcCfgsUfsu | 4291 |
| D-3627 | CfgGfaCfuaCfGfaGfaCfgGfgCfuUfuUf | 3641 | aAfgCfcCfgUfcUfcgUfAfgUfcCfgsUfsu | 4292 |
| D-3628 | CfgGfaCfuAfcGfaGfAfcgGfgCfuUfuUf | 3642 | aAfgCfcCfGfucUfcGfuAfgUfcCfgsUfsu | 4293 |
| D-3629 | CfsgsGfaCfuaCfGfaGfaCfgGfgCfuUfuUf | 3643 | asAfsgCfcCfgUfcUfcgUfAfgUfcCfgsUfsu | 4294 |
| D-3630 | CfgGfaCfuaCfGfaGfaCfgGfgCfuUfuUf | 3644 | aAfgCfcCfgUfcUfcgUfAfgUfcCfgUfu | 4295 |
| D-3631 | CfsgsGfaCfuAfcGfaGfAfcgGfgCfuUfuUf | 3645 | asAfsgCfcCfGfucUfcGfuAfgUfcCfgsUfsu | 4296 |
| D-3632 | CfgGfaCfuAfcGfaGfAfcgGfgCfuUfuUf | 3646 | aAfgCfcCfGfucUfcGfuAfgUfcCfgUfu | 4297 |
| D-3633 | CfgGfaCfUfacGfaGfaCfgGfgCfuUfuUf | 3647 | aAfgCfcCfgUfcUfcGfUfagUfcCfgsUfsu | 4298 |
| D-3634 | CfgGfacUfAfcGfaGfaCfgGfgCfuUfuUf | 3648 | aAfgCfcCfgUfcUfcGfuaGfUfcCfgsUfsu | 4299 |
| D-3635 | CfgGfAfcuAfcGfaGfaCfgGfgCfuUfuUf | 3649 | aAfgCfcCfgUfcUfcGfuAfGfucCfgsUfsu | 4300 |
| D-3636 | CfggAfCfuAfcGfaGfaCfgGfgCfuUfuUf | 3650 | aAfgCfcCfgUfcUfcGfuAfguCfCfgsUfsu | 4301 |
| D-3637 | CfGfgaCfuAfcGfaGfaCfgGfgCfuUfuUf | 3651 | aAfgCfcCfgUfcUfcGfuAfgUfCfcgsUfsu | 4302 |
| D-3638 | cGfGfaCfuAfcGfaGfaCfgGfgCfuUfuUf | 3652 | aAfgCfcCfgUfcUfcGfuAfgUfccGfsUfsu | 4303 |
| D-3639 | cgGfaCfuAfcGfaGfaCfgGfgCfuUfuUf | 3653 | aAfgCfcCfgUfcUfcGfuAfgUfcCfGfsusu | 4304 |
| D-3640 | CfgGfaCfuAfcGfaGfacGfGfgCfuUfuUf | 3654 | aAfgCfccGfUfcUfcGfuAfgUfcCfgsUfsu | 4305 |
| D-3641 | CfgGfaCfuAfcGfaGfaCfGfggCfuUfuUf | 3655 | aAfgCfCfcgUfcUfcGfuAfgUfcCfgsUfsu | 4306 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3642 | CfgGfaCfuAfcGfaGfaCfggGfCfuUfuUf | 3656 | aAfgcCfCfgUfcUfcGfuAfgUfcCfgsUfsu | 4307 |
| D-3643 | CfgGfaCfuAfcGfaGfaCfgGfGfcuUfuUf | 3657 | aAfGfccCfgUfcUfcGfuAfgUfcCfgsUfsu | 4308 |
| D-3644 | CfgGfaCfuAfcGfaGfaCfgGfgcUfUfuUf | 3658 | aaGfCfcCfgUfcUfcGfuAfgUfcCfgsUfsu | 4309 |
| D-3645 | CfgGfaCfuAfcGfaGfaCfgGfgCfUfuuUf | 3659 | AfagCfcCfgUfcUfcGfuAfgUfcCfgsUfsu | 4310 |
| D-3646 | CfgGfaCfuAfcGfaGfaCfgGfgCfuuUfUf | 3660 | AfAfgCfcCfgUfcUfcGfuAfgUfcCfgsUfsu | 4311 |
| D-3647 | CfGfgaCfUfacGfAfgaCfGfggCfUfuuUf | 3661 | AfagCfCfcgUfCfucGfUfagUfCfcgsUfsUf | 4312 |
| D-3648 | cgGfAfcuAfCfgaGfAfcgGfGfcuUfUfu | 3662 | aAfGfccCfGfucUfCfguAfGfucCfGfsusu | 4313 |
| D-3649 | CfggAfCfuaCfGfagAfCfggGfCfuuUfUf | 3663 | AfAfgcCfCfguCfUfcgUfAfguCfCfgsusUf | 4314 |
| D-3650 | cGfGfacUfAfcgAfGfacGfGfgcUfUfuu | 3664 | aaGfCfccGfUfcuCfGfuaGfUfccGfsUfsu | 4315 |

Synthesis of chemically modified siRNA sequences was performed on the GE AKTA OligoPilot 100.

Materials:

- Acetonitrile (DNA Synthesis Grade, AXO152-2505, EMD)
- Capping Reagent A (20% N-methylimidazole in acetonitrile, BI0224-0505, EMD, Lot #56090)
- Capping Reagent B1 (20% acetic anhydride in acetonitrile, BI0347-0505, EMD, Lot #55015)
- Capping Reagent B2 (30% 2,6-lutidine in aceotnitrile, BI0349-0505, EMD, Lot #55176)
- Capping Reagent B1 and B2 were mixed together 1:1 (v/v).
- Activator (0.3 M benzylthiotetrazole (BTT) in acetonitrile, BI0166-1005, EMD Lot #55106, over molecular sieves)
- Detritylation Reagent (3% dichloroacetic acid in toluene, BIO832-2505, EMD, Lot #55316)
- Oxidation Reagent (0.05 M iodine in 90:10 pyridine/water, BIO424-1005, EMD, Lot #54323)
- Diethylamine solution (20% DEA in acetonitrile, NC0017-0505, EMD, Lot #55202)
- Ammonium hydroxide (concentrated, J. T. Baker)
- Thiolation Reagent, 0.2 M phenylacetic disulfide (PADS, Aldrich) in 50:50 2-methylpyridine (picoline, Aldrich)/N-methylpyrrolidinone (NMP), Aldrich)
- Thymidine (Thermo Fisher Scientific) and 2'-O-methyl and 2'-fluoro phosphoramidites of adenosine, guanosine, cytosine, and uridine (Thermo Fisher Scientific), 0.15 M in acetonitrile over ~10 mL of molecular sieves (J. T. Baker)
- Primer Support 5G UnyLinker 350, Lot #10236161, 343 μmol/g, 0.60 g (206 μmol) or Primer Support 5G Amino with GalNAc cluster Synthesis:

Reagent solutions, phosphoramidite solutions, and solvents were attached to the instrument. Solid support was added to the column (6.3 mL), and the column was affixed to the instrument. The column was flushed with acetonitrile. The synthesis was started using the Unicorn software. The phosphoramidite and reagent solution lines were purged. The synthesis was accomplished by repetition of the deprotection/coupling/oxidation/capping synthesis cycle. To the solid support was added detritylation reagent to remove the 5'-dimethoxytrityl (DMT) protecting group. The solid support was washed with acetonitrile. To the support was added phosphoramidite and activator solution followed by recycling to couple the incoming nucleotide to the free 5'-hydroxyl group. The support was washed with acetonitrile. To the support was added oxidation or thiolation reagent to convert the phosphite triester to the phosphate triester or phosphorothioate. To the support was added capping reagents A and B to terminate any unreacted oligonucleotide chains. The support was washed with acetonitrile. After the final reaction cycle, the resin was washed with diethylamine solution to remove the 2-cyanoethyl protecting groups. The support was washed with acetonitrile.

Cleavage:

The synthesis column was removed from the synthesizer and dried under vacuum for 20 minutes. The column was opened, and the solid support was transferred to a 100 ml bottle. To the solid support was added 40 mL of concentrated ammonium hydroxide. The cap was tightly affixed to the bottle, and the mixture was heated at 65° C. overnight. The bottle was moved to the freezer and cooled for 20 minutes before opening in the hood. The mixture was filtered through a 60 mL M fritted glass funnel. The bottle and solid support were rinsed with 20 mL of 50:50 ethanol/water and then 40 mL of water.

Analysis and Purification:

A portion of the combined filtrate was analyzed and purified by anion exchange chromatography. The pooled fractions were desalted by size exclusion chromatography and analyzed by ion pair-reversed phase HPLC. The pooled fractions were lyophilized to obtain a white amorphous powder.

Analytical Anion Exchange Chromatography (AEX):

- Column: Thermo DNAPac PA200RS (4.6×50 mm, 4 μm)
- Instrument: Agilent 1100 HPLC
- Buffer A: 20 mM sodium phosphate, 10% acetonitrile, pH 8.5

Buffer B: 20 mM sodium phosphate, 10% acetonitrile, pH 8.5, 1 M sodium bromide

Flow rate: 1 mL/min at 40° C.

Gradient: 20-65% B in 6.2 min

Preparative Anion Exchange Chromatography (AEX):

Column: Tosoh TSK Gel SuperQ-5 PW, 21×150 mm, 13 μm

Instrument: Agilent 1200 HPLC

Buffer A: 20 mM sodium phosphate, 10% acetonitrile, pH 8.5

Buffer B: 20 mM sodium phosphate, 10% acetonitrile, pH 8.5, 1 M sodium bromide

Flow rate: 8 mL/min

Injection volume: 5 mL

Gradient: 35-55% B over 20 min

Preparative Size Exclusion Chromatography (SEC):

Column: GE Hi-Prep 26/10

Instrument: GE AKTA Pure

Buffer: 20% ethanol in water

Flow Rate: 10 mL/min

Injection volume: 15 mL using sample loading pump

Ion Pair-Reversed Phase (IP—RP) HPLC:

Column: Water Xbridge BEH OST C18, 2.5 μm, 2.1×50 mm

Instrument: Agilent 1100 HPLC

Buffer A: 15.7 mM DIEA, 50 mM HFIP in water

Buffer B: 15.7 mM DIEA, 50 mM HFIP in 50:50 water/acetonitrile

Flow rate: 0.5 mL/min

Gradient: 10-30% B over 6 min

Annealing:

A small amount of the sense strand and the antisense strand were weighed into individual vials. To the vials was added siRNA reconstitution buffer (Qiagen) to an approximate concentration of 2 mM based on the dry weight. The actual sample concentration was measured on the NanoDrop One (ssDNA, extinction coefficient=33 μg/OD260). The two strands were then mixed in an equimolar ratio, and the sample was heated for 3 minutes in a 90° C. water bath and allowed to cool slowly to room temperature. The sample was analyzed by AEX. The RNA duplex was observed to have a longer retention time by analytical AEX than the single strands. The duplex was registered and submitted for in vitro (see methods described in Examples 2 and 3) and in vivo (see methods described in Example 6) testing.

Example 5. Synthesis of GalNAc-Containing Ligand

This example describes the synthesis of a tetravalent GalNAc moiety, which can be conjugated to the double-stranded RNA molecules in the RNAi constructs of the invention to facilitate delivery and uptake of the RNAi constructs by the liver (e.g. hepatocytes). The synthetic scheme is depicted in FIG. 5.

Resin-Bound Tetraantennary GalNAc

Step 1: (S)-4-(2-((((9H-fluoren-9-yl) methoxy) carbonyl)amino)-3-(trityloxy) propoxy)-4-oxobutanoic acid (1)

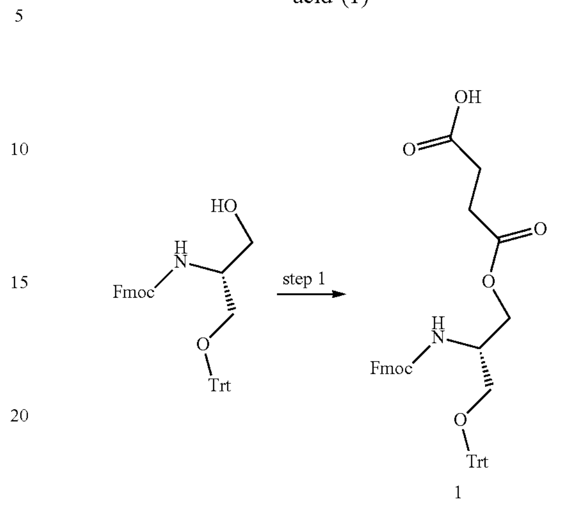

1

The (R)-(9H-fluoren-9-yl)methyl (1-hydroxy-3-(trityloxy) propan-2-yl) carbamate (20 g, 36.0 mmol), succinic anhydride (7.20 g, 72 mmol), polystyrene-supported DMAP (3 mmol/g, 24 g, 72 mmol) and triethylamine (10 mL, 72 mmol) were taken up in DCM (720 mL). The suspension was stirred at room temperature for 16 h. The reaction was filtered through Celite (to remove PS-dmap), and the filter cake was rinsed with DCM (200 mL). The combined filtrate was extracted with saturated aqueous NaCl (3×100 mL). The organic layer was dried over sodium sulfate and concentrated to afford the crude title compound (23.6 g, 36.0 mmol, 100% yield) which was used in the next step without further purification. MS m/z 678.2 (M+Na).

Step 2:

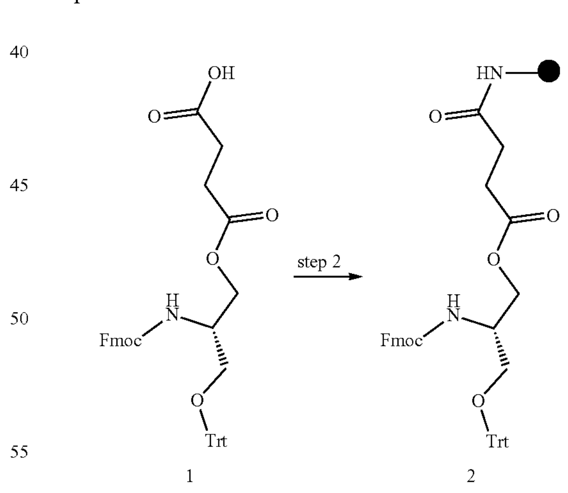

1 2

In a 50-mL conical tube, the activated hemisuccinate was prepared as follows: (S)-4-(2-((((9H-fluoren-9-yl) methoxy) carbonyl)amino)-3-(trityloxy) propoxy)-4-oxobutanoic acid (0.5 g, 0.763 mmol) and TATU (344 mg, 1.07 mmol) were dissolved in 5 mL of DMF, and the tube was swirled for 3 minutes. Hunig's base (0.400 mL, 2.29 mmol) was added. Meanwhile, the resin (Primer Support 5G Amino from GE Lifesciences, 0.46 mmol/g, 1.66 g, 0.763 mmol) was swelled in a 50-mL falcon tube in 10 mL of DMF. The activated hemisuccinate solution was added. The tube was gently shaken at room temperature at 400 rpm. The reaction mixture was filtered, then rinsed with DCM (50 mL), 10% MeOH-DCM (50 mL), then DCM (50 mL) and dried under vacuum. The resin was capped by adding a solution of acetic anhydride (5.625 mL, 59 mmol), pyridine (16.65 mL) and triethylamine (0.225 mL), and shaking at 400 rpm for 2 h at room temperature. The resin was filtered, rinsed with DCM (50 mL), 10% MeOH-DCM (50 mL), and DCM (50 mL) and dried under vacuum, to afford Intermediate 2 (2.55 g, 0.255 mmol/g, 0.65 mmol), which was used as is in the next step.

Step 3:

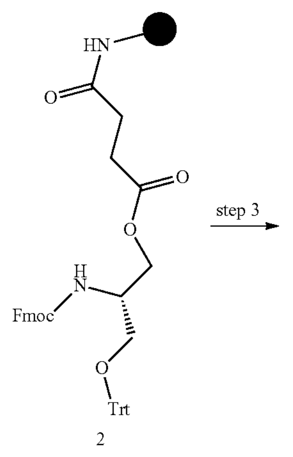

2

-continued

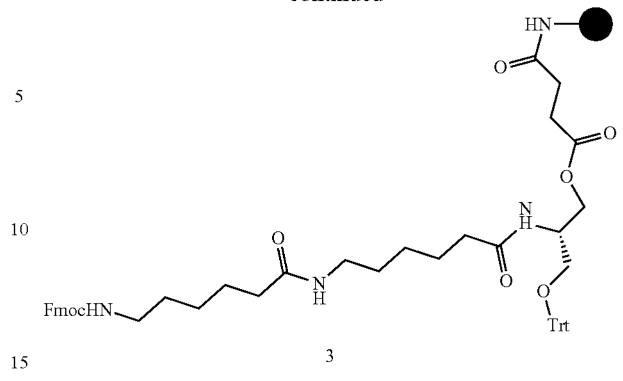

3

Intermediate 2 (2.55 g, 0.65 mmol) was suspended in a solution of 20% 4-methylpiperidine in DMF (15 mL) and stirred for 5 minutes. The solution was drained, and the process was repeated two more times to afford the deprotected intermediate. An activated solution of Fmoc-protected 6-aminohexanoic acid was made by dissolving Fmoc-protected 6-aminohexanoic acid (1.41 g, 4.0 mmol) and TATU (1.288 g, 4.0 mmol) in DMF (10 mL). After 5 minutes, Hunig's base (1.05 mL, 6.05 mmol) was added. This solution was added to the deprotected resin. The mixture was shaken at 400 rpm at room temperature overnight. The reaction was filtered, and the resin was washed with DMF (3×30 mL). The same procedure (deprotection, preparation of the activated acid, and coupling) was repeated to afford crude Intermediate 3 (2.40 g, 0.184 mmol/g, 0.442 mmol), which was used in the next step.

Step 4:

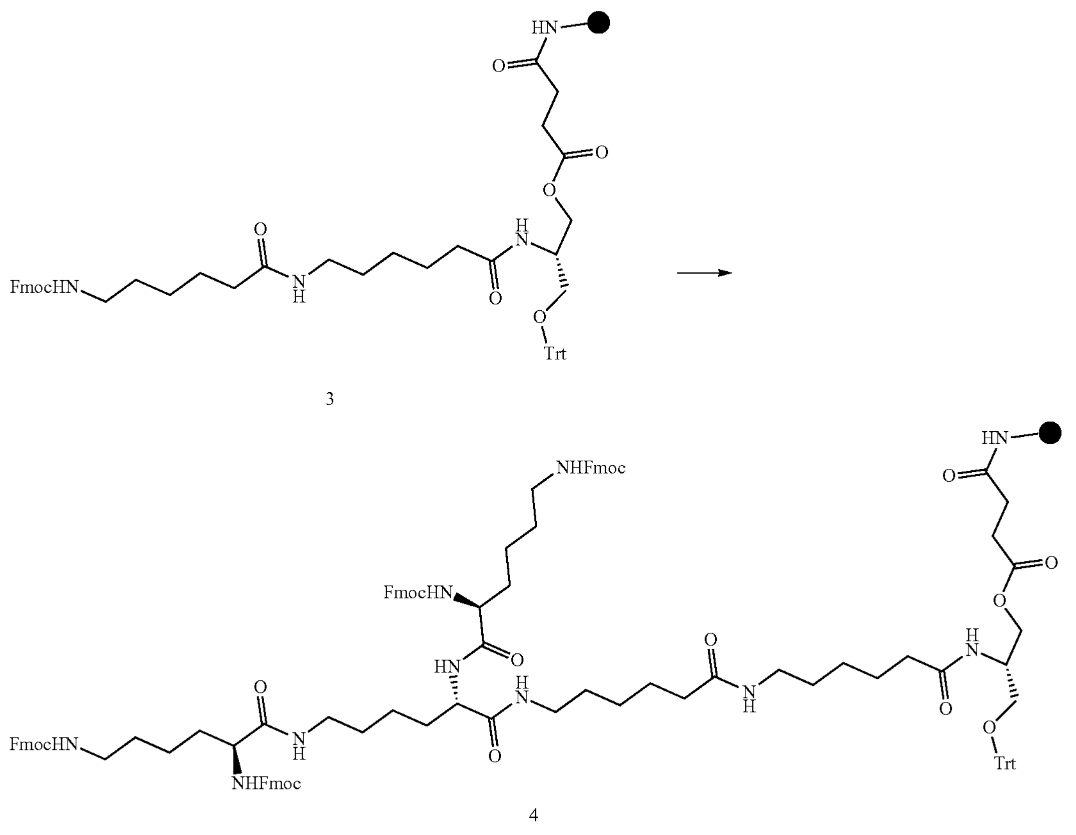

3

4

Intermediate 3 was suspended in a solution of 20% 4-methylpiperidine in DMF (15 mL) and stirred for 5 minutes. The solution was drained, and the process was repeated two more times to afford the deprotected intermediate. An activated solution of bis-Fmoc-protected lysine was prepared by dissolving bis-Fmoc-protected lysine (2.07 g, 3.5 mmol) and TATU (1.13 g, 3.5 mmol) in DMF (10 mL) and stirring for 5 minutes. Hunig's base (0.96 mL, 5.5 mmol) was added. This solution was added to the deprotected resin. The suspension was shaken at 400 rpm at room temperature overnight. The reaction mixture was filtered, and the resin was then washed with DMF (3×30 mL). The resin was deprotected using the procedure above. An activated solution of bis-Fmoc-protected lysine was prepared as above, except that the amount of bis-Fmoc-protected lysine was 2.96 g (5.0 mmol), the amount of TATU was 1.61 g (5.0 mmol), and the amount of Hunig's base was 1.31 mL (7.5 mmol), and the deprotected resin was coupled to the activated acid by shaking at 400 rpm at room temperature overnight. The resin was washed with DMF (3×30 mL) and then DCM (3×30 mL), and dried to afford crude Intermediate 4 (2.28 g, 0.165 mmol/g, 0.376 mmol).

Step 5:

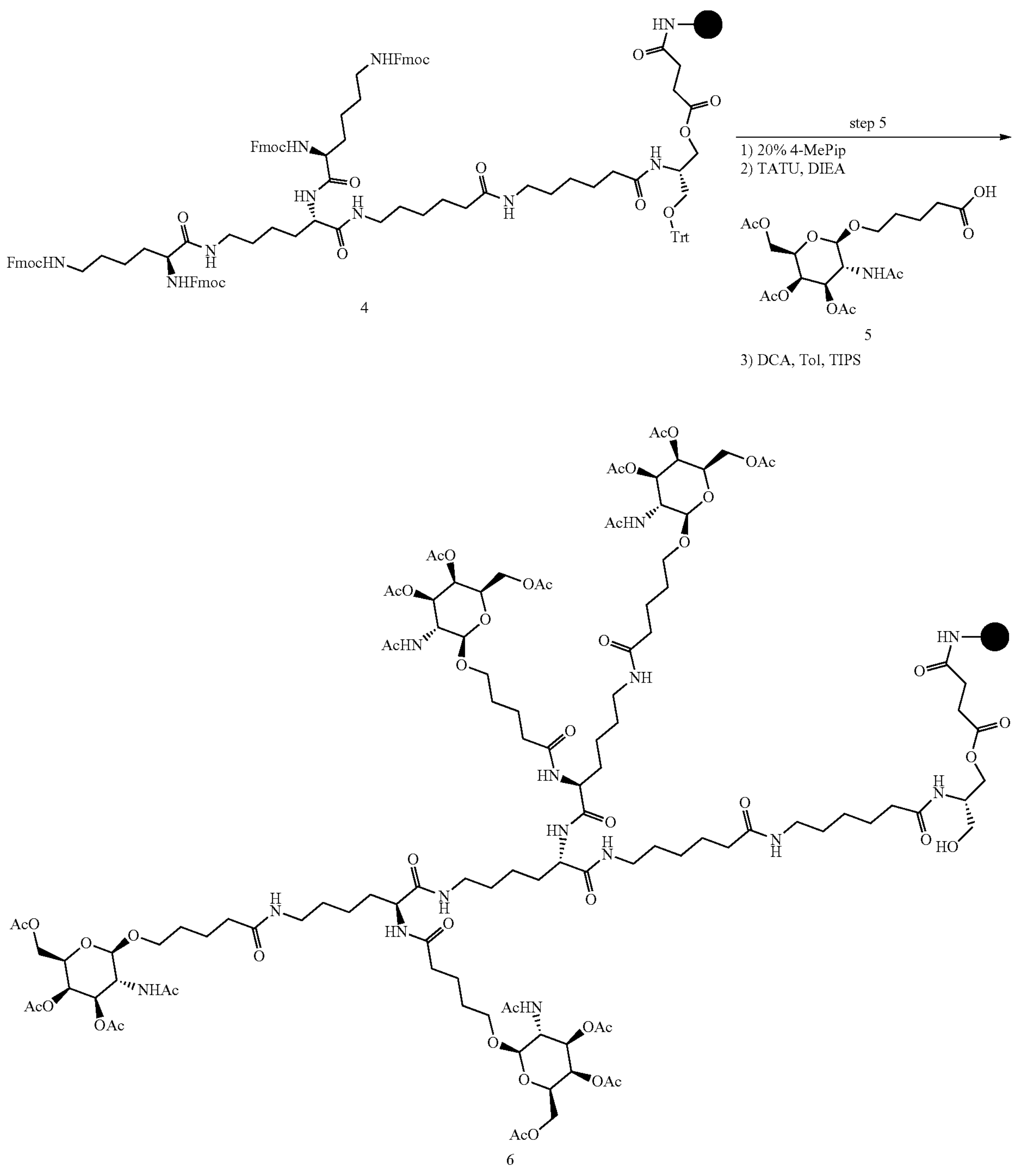

Intermediate 4 (0.4 mmol) was suspended in a solution of 20% 4-methylpiperidine in DMF (25 mL) and stirred for 5 minutes. The solution was drained, and the process was repeated one more time to afford the deprotected intermediate. To a solution of 5-(((2R,3R,4R,5R,6R)-3-acetamido-4,5-diacetoxy-6-(acetoxymethyl)tetrahydro-2H-pyran-2-yl) oxy) pentanoic acid (5, 2.68 g, 6 mmol) in DMF (20 mL) was added TATU (1.92 g, 6.0 mmol) and the solution was stirred for 5 min. Hunig's base (1.57 mL, 9.0 mmol) was added to the solution and the mixture was then added to the deprotected intermediate. The suspension was kept at room temperature overnight and the solvent was drained. The resin was washed with DMF (3×30 mL) and DCM (3×30 mL). The resin was treated with 3% Dichloroacetic acid in Tol with 5% TIPS (25 mL) and after 5 min the solvent was drained. The process was repeated two more times to give intermediate 6, which was used in the next step directly (e.g. conjugation reaction to 5' or 3' end of sense strand of an RNAi construct of the invention).

The chemically modified ASGR1 siRNAs alone or conjugated to the GalNAc moiety are evaluated for efficacy in reducing ASGR1 expression by the in vitro immunoassay described in Example 2, the RNA FISH assay described in Example 3, or the in vivo mouse model described in Example 6.

Example 6. In Vivo Efficacy of ASGR1 siRNA Molecules

To assess the efficacy of chemically modified ASGR1 siRNA molecules in reducing ASGR1 liver expression in vivo, the modified ASGR1 siRNA molecules (complexed with Invivofectamine® reagent) or GalNAc-siRNA conjugates are administered to C57BL/6J mice intravenously or subcutaneously. Specifically, mice are injected with buffer, indicated siRNA and matched control siRNA at 1-5 mg/kg body weight in 0.25 ml buffer on day 0. Animals are harvested for further analysis at day 2, day 4 and day 7. Liver total RNA from harvested animals is processed for qPCR analysis. The efficacy of the ASGR1 siRNA is assessed by comparing the amount of Asgr1 mRNA and ASGR1 protein in liver tissue of the siRNA-treated animals to the amount of Asgr1 mRNA and ASGR1 protein in liver tissue of animals injected with buffer or control siRNAs.

Serum levels of alkaline phosphatase and LDL cholesterol may also be measured in the mice at various times following injection with ASGR1 siRNA molecules or matched controls to assess the in vivo efficacy of ASGR1 siRNA molecules. Elevated serum alkaline phosphatase levels correlate with reduced serum levels of non-HDL cholesterol and reduced risk of coronary artery disease (Nioi et al., New England Journal of Medicine, Vol. 374 (22): 2131-2141, 2016, which is hereby incorporated by reference in its entirety). Thus, serum alkaline phosphatase levels can be used as a surrogate biomarker of efficacy of a particular ASGR1 siRNA to reduce serum non-HDL cholesterol levels or risk of coronary artery disease. Efficacious ASGR1 siRNA molecules are those that produce reduced serum non-HDL cholesterol (e.g. LDL cholesterol) levels or increased serum alkaline phosphatase levels in treated animals as compared to the levels in animals injected with buffer or control siRNAs.

Example 7. In Vitro Efficacy of ASGR1 Chemically Modified siRNA Molecules

Select chemically modified siRNA molecules listed in Table 6 were conjugated to the triantennary GalNAc moiety shown in Formula VII, the structure of which is reproduced below. The GalNAc moiety was conjugated to the 3' end of the sense strand of each duplex through a phosphodiester linkage.

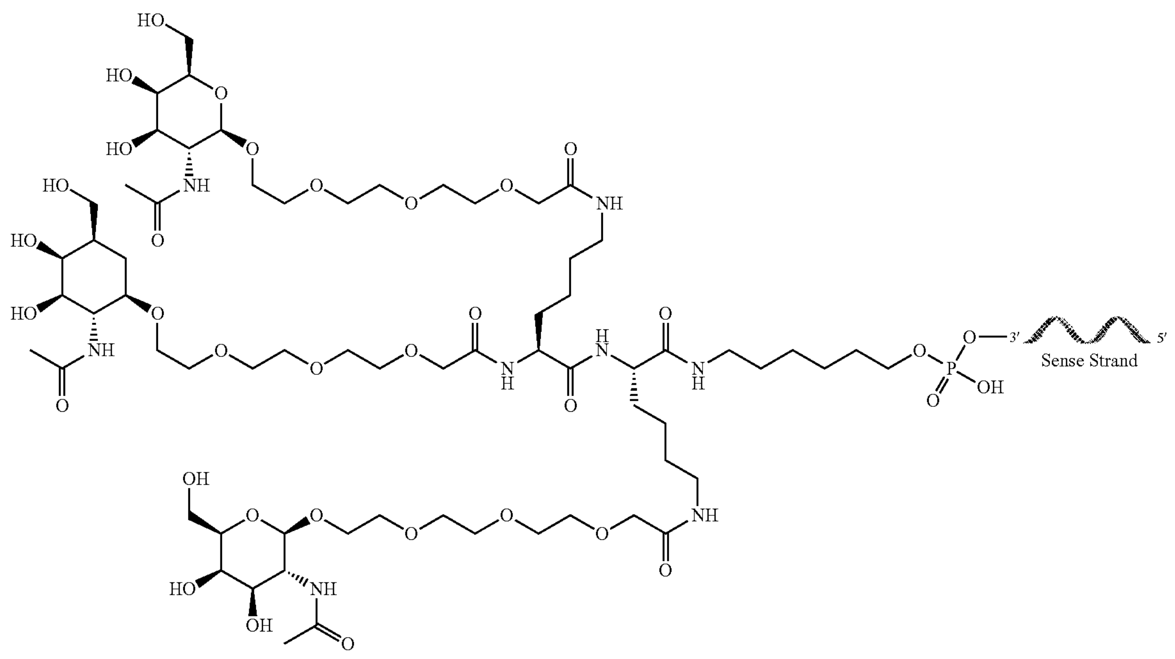 [SMILES: COP(=O)(O)OCCCCCCNC(=O)[C@H](CCCCNC(=O)COCCOCCOCCO[C@@H]1O[C@H](CO)[C@H](O)[C@H](O)[C@H]1NC(C)=O)NC(=O)[C@H](CCCCNC(=O)COCCOCCOCCO[C@@H]1O[C@H](CO)[C@H](O)[C@H](O)[C@H]1NC(C)=O)NC(=O)COCCOCCOCCO[C@@H]1C[C@H](CO)[C@H](O)[C@H](O)[C@H]1NC(C)=O]

The GalNAc-siRNA conjugates were evaluated for their ability to inhibit ASGR1 expression in the Hep3B cell transfection assay and human ASGR1 CHO cell free uptake assay. The Hep3B cell transfection immunoassay is described in Example 2 above. The free uptake assay utilizing Chinese Hamster Ovary (CHO) cells stably expressing human ASGR1 was conducted as follows. GalNAc-conjugated siRNA molecules in F-12K media (Corning Cellgro #10-025-CV) were prepared in 384-well plates. CHO cells stably expressing human ASGR1 in F-12K media supplemented with 10% fetal bovine serum and 1% antibiotic/antimycotic were added to each well. Cells were incubated for 4 days at 37° C. and 5% $CO_2$. Four days after siRNA delivery, cells were fixed in formaldehyde, blocked with bovine serum albumin, and subsequently stained with an anti-ASGR1 primary antibody (Amgen clone 7E11, light and heavy chain sequences provided in SEQ ID NOs: 3 and 4, respectively) for either 1 hour at room temperature or overnight at 4° C. Plates were washed three times with phosphate buffered saline (PBS). Cells were then incubated in the dark for 45 minutes at room temperature with Alexa488-conjugated anti-human IgG secondary antibody and nuclear stain Hoechst 33342 (Invitrogen #H3570) to assess cell number. Following three PBS washes, the plates were imaged on an Opera Phenix high-content screening system (PerkinElmer) using 488/500-550 and 375/435-480 excitation/emission filter settings to measure anti-ASGR1 antibody staining and nuclear staining, respectively. Data were analyzed using Columbus image analysis software and GeneData Screener software to quantify several measures of ASGR1 protein levels, cell count, and cell morphology on a per cell and per well basis.

The GalNAc-siRNA conjugates were tested at twenty-two different doses ranging from 0.000012 to 25 μM in each of the assays and dose-response curves were constructed. IC50 values and maximum antagonist activity values (relative to control cells; −1.0 max antagonist activity represents complete inhibition) were calculated from the dose-response curves. The results of the assays are shown in Table 7 below.

TABLE 7

In vitro efficacy of GalNAc-ASGRI siRNA conjugates

| Duplex No. | Hep3B Transfected IC50 (μM) | Hep3B Transfected Max Antagonist Activity | hASGR1 CHO Free Uptake IC50 (μM) | hASGR1 CHO Free Uptake Max Antagonist Activity |
|---|---|---|---|---|
| D-3033 | 0.00325 | −0.84 | >0.5 | −0.34 |
| D-3034 | >0.167 | −0.46 | >0.5 | −0.08 |
| D-3036 | 0.00355 | −0.97 | >0.5 | −0.48 |
| D-3037 | 0.00395 | −0.96 | >0.5 | −0.55 |
| D-3044 | >0.5 | −0.05 | >0.5 | 0.13 |
| D-3046 | 0.00481 | −0.82 | >0.5 | −0.14 |
| D-3048 | 0.00288 | −0.93 | >0.5 | −0.31 |
| D-3050 | 0.00386 | −0.99 | >0.5 | −0.36 |
| D-3051 | 0.0124 | −0.82 | >0.5 | −0.51 |
| D-3053 | 0.00349 | −0.84 | >0.5 | −0.48 |
| D-3055 | 0.00346 | −0.82 | >0.5 | −0.26 |
| D-3057 | 0.0021 | −0.86 | >0.5 | −0.58 |
| D-3058 | >0.5 | 0.04 | >0.5 | 0.26 |
| D-3059 | 0.00966 | −0.82 | >0.5 | −0.12 |
| D-3060 | 0.00527 | −0.71 | >0.5 | −0.06 |
| D-3061 | >0.5 | 0.14 | >0.5 | −0.20 |
| D-3063 | 0.00541 | −1.0 | 0.395 | −0.20 |
| D-3071 | 0.00435 | −0.9 | >12.5 | −0.10 |
| D-3094 | 0.00544 | −0.9 | >25.0 | −0.40 |
| D-3102 | 0.00649 | −0.9 | >12.5 | −0.10 |
| D-3125 | 0.00144 | −0.9 | 0.694 | −0.40 |
| D-3133 | 0.00245 | −0.8 | >12.5 | −0.20 |

TABLE 7-continued

In vitro efficacy of GalNAc-ASGRI siRNA conjugates

| Duplex No. | Hep3B Transfected IC50 (μM) | Hep3B Transfected Max Antagonist Activity | hASGR1 CHO Free Uptake IC50 (μM) | hASGR1 CHO Free Uptake Max Antagonist Activity |
|---|---|---|---|---|
| D-3156 | 0.00206 | −0.5 | >25.0 | −0.10 |
| D-3164 | 1.17 | −0.4 | 2.14 | −0.10 |
| D-3187 | 0.00653 | −0.6 | >25.0 | −0.10 |
| D-3195 | >0.0977 | −0.5 | 0.179 | −0.10 |
| D-3219 | >0.5 | 0.08 | >0.5 | −0.09 |
| D-3220 | >0.5 | 0.12 | >0.5 | −0.11 |
| D-3222 | 0.00406 | −0.95 | >0.5 | −0.14 |
| D-3223 | 0.00818 | −0.74 | >0.5 | −0.07 |
| D-3228 | 0.000479 | −0.9 | >25.0 | −0.20 |
| D-3230 | >12.5 | −0.2 | >25.0 | −0.10 |
| D-3231 | >12.5 | −0.2 | >25.0 | −0.20 |
| D-3232 | 0.30214 | −0.6 | >25.0 | −0.10 |
| D-3233 | 0.00468 | −0.4 | >25.0 | −0.10 |
| D-3234 | 1.5879 | −0.8 | >25.0 | 0.20 |
| D-3235 | 0.00109 | −0.9 | >25.0 | 0.10 |
| D-3236 | 0.0047 | −0.7 | >25.0 | −0.20 |
| D-3237 | 0.000178 | −0.9 | >25.0 | −0.20 |
| D-3238 | 0.00336 | −0.9 | >25.0 | −0.30 |
| D-3239 | 0.00394 | −0.9 | >25.0 | −0.20 |
| D-3240 | 0.00458 | −0.9 | >25.0 | −0.20 |
| D-3241 | >12.5 | −0.2 | >25.0 | −0.10 |
| D-3242 | >12.5 | −0.2 | >25.0 | 0.20 |
| D-3243 | 0.00122 | −0.9 | >25.0 | −0.10 |
| D-3244 | >12.5 | −0.1 | >25.0 | 0.10 |
| D-3245 | >12.5 | −0.4 | >25.0 | 0.10 |
| D-3246 | >12.5 | −0.2 | >25.0 | −0.20 |
| D-3247 | >12.5 | −0.2 | >25.0 | −0.10 |
| D-3249 | 0.0137 | −0.6 | >25.0 | 0.00 |
| D-3257 | 2.33 | −0.4 | >12.5 | −0.30 |
| D-3280 | 0.00407 | −1.0 | >25.0 | −0.10 |
| D-3288 | 0.011 | −0.7 | >12.5 | 0.10 |
| D-3311 | 0.0068 | −0.8 | >25.0 | −0.20 |
| D-3319 | >12.5 | −0.3 | >12.5 | 0.00 |
| D-3342 | 0.00217 | −0.9 | 0.703 | −0.30 |
| D-3350 | 0.00512 | −0.7 | >12.5 | −0.10 |
| D-3373 | 0.00961 | −0.6 | >25.0 | 0.00 |
| D-3381 | >12.5 | −0.2 | >12.5 | −0.20 |
| D-3404 | 0.00497 | −0.8 | >25.0 | −0.30 |
| D-3412 | 0.00915 | −0.6 | >12.5 | −0.10 |
| D-3435 | 0.00302 | −0.7 | >25.0 | 0.10 |
| D-3443 | >12.5 | −0.3 | >6.25 | −0.20 |
| D-3467 | 0.00473 | −0.7 | >25.0 | −0.20 |
| D-3468 | >12.5 | −0.2 | >25.0 | 0.20 |
| D-3470 | 0.079127 | −0.9 | >25.0 | −0.30 |
| D-3471 | 0.38449 | −0.9 | >25.0 | −0.10 |
| D-3474 | 0.648 | −0.4 | >25.0 | 0.00 |
| D-3476 | 0.23421 | −0.9 | >25.0 | −0.40 |
| D-3478 | >12.5 | −0.1 | >25.0 | 0.20 |
| D-3479 | 0.948 | −0.3 | >25.0 | −0.10 |
| D-3480 | 0.274 | −0.5 | >25.0 | 0.10 |
| D-3481 | 0.00181 | −0.8 | >25.0 | 0.00 |
| D-3482 | 0.54988 | −0.9 | >25.0 | −0.10 |
| D-3483 | 0.35517 | −0.9 | >25.0 | −0.20 |
| D-3484 | 1.3218 | −0.9 | >25.0 | −0.20 |
| D-3485 | 0.00376 | −0.9 | 1.71 | −0.30 |
| D-3486 | 0.0054 | −0.9 | >25.0 | −0.10 |
| D-3487 | 0.00419 | −0.8 | >25.0 | −0.20 |
| D-3488 | 0.00582 | −0.9 | >25.0 | −0.10 |
| D-3489 | 0.737 | −0.3 | >25.0 | 0.10 |
| D-3490 | >12.5 | 0.0 | >25.0 | −0.10 |
| D-3491 | 0.00799 | −0.8 | 2.53 | −0.30 |
| D-3505 | >12.5 | −0.3 | 11 | −0.30 |
| D-3528 | 0.000536 | −1.0 | >25.0 | −0.10 |
| D-3536 | 0.00559 | −0.8 | >12.5 | 0.10 |
| D-3559 | 0.00285 | −1.0 | >25.0 | 0.00 |
| D-3567 | 0.0027 | −1.0 | >25.0 | −0.20 |

Several of the GalNAc-siRNA conjugates knocked down ASGR1 expression by greater than 80% when transfected into Hep3B cells. In particular GalNAc-siRNA conjugates targeting nucleotides 692 to 710 of the human ASGR1 transcript variant 1 (NM_001671.4; SEQ ID NO: 1) having various chemical modification patterns (e.g. Duplex Nos. 3036, 3037, 3051, 3053, and 3057) exhibited low nanomolar IC50 values when transfected into Hep3B cells and about 50% maximum knockdown activity in the CHO cell free uptake assay. Changing the GalNAc moiety in the conjugates to other triantennary GalNAc structures described herein (e.g. Formula XVI) improved performance of the GalNAc-siRNA conjugates in the free uptake assay (data not shown).

Example 8. Design and Efficacy of Additional GalNAc-ASGR1 siRNA Molecules

Additional GalNAc-ASGR1 siRNA conjugates were made that had varying patterns of chemical modifications, different sequences, and different GalNAc moieties. Table 8 below lists the modifications in the sense and antisense sequences and the structure and site of conjugation for the GalNAc moiety for each of the GalNAc-ASGR1 siRNA conjugates. The nucleotide sequences in Table 8 are listed according to the following notations: A, U, G, and C=corresponding ribonucleotide; dT, dA, dG, dC=corresponding deoxyribonucleotide; a, u, g, and c=corresponding 2'-O-methyl ribonucleotide; Af, Uf, Gf, and Cf=corresponding 2'-deoxy-2'-fluoro ("2'-fluoro") ribonucleotide; Phos=terminal nucleotide has a monophosphate group at its 5' end; and invAb=inverted abasic nucleotide (i.e. abasic nucleotide linked to adjacent nucleotide via a substitutent at its 3' position (a 3'-3' linkage)). Insertion of an "s" in the sequence indicates that the two adjacent nucleotides are connected by a phosphorothiodiester group (e.g. a phosphorothioate internucleotide linkage). Unless indicated otherwise, all other nucleotides are connected by 3'-5' phosphodiester groups. GalNAc structures are shown in the referenced formulas, which are depicted above.

TABLE 8

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3651 | Formula VII | 3' end of sense strand | {Phos}GfsusGfgGfaAfGfAfAfdAgAfuGfaAfgUfuUf | 4319 | {Phos}asCfsuUfcAfuCfuuucuUfcCfcAfcsUfsu | 4513 |
| D-3652 | Formula VII | 3' end of sense strand | {Phos}GfsusGfgGfaAfGfdAAfAfgAfuGfaAfgUfuUf | 4320 | {Phos}asCfsuUfcAfuCfuuucuUfcCfcAfcsUfsu | 4513 |
| D-3653 | Formula VII | 3' end of sense strand | {Phos}GfsusGfgGfaAfgdAAfAfGfAfuGfaAfgUfuUf | 4321 | {Phos}asCfsuUfcAfucuuuCfuUfcCfcAfcsUfsu | 4514 |
| D-3654 | Formula VII | 3' end of sense strand | {Phos}GfsusGfgGfaAfgAfAfdAGfAfuGfaAfgUfuUf | 4322 | {Phos}asCfsuUfcAfucuuuCfuUfcCfcAfcsUfsu | 4514 |
| D-3655 | Formula VII | 3' end of sense strand | {Phos}GfsusGfgGfaaGfAfadAgAfuGfaAfgUfuUf | 4323 | {Phos}asCfsuUfcAfuCfuUfucUfUfcCfcAfcsUfsu | 4515 |
| D-3656 | Formula VII | 3' end of sense strand | {Phos}GfsusGfgGfaaGfAfdAAfgAfuGfaAfgUfuUf | 4324 | {Phos}asCfsuUfcAfuCfuUfucUfUfcCfcAfcsUfsu | 4515 |
| D-3657 | Formula VII | 3' end of sense strand | {Phos}GfsusGfgGfaaGfdAaAfgAfuGfaAfgUfuUf | 4325 | {Phos}asCfsuUfcAfuCfuUfucUfUfcCfcAfcsUfsu | 4515 |
| D-3658 | Formula VII | 3' end of sense strand | {Phos}gsusgggaAfgAfadAgaugaaguuu | 4326 | {Phos}asCfsuUfcAfuCfuUfuCfuUfcCfcacsusu | 4516 |
| D-3659 | Formula VII | 3' end of sense strand | {Phos}GfsusGfgGfaAfGfAfAfAfgAfuGfaAfguuu | 4327 | {Phos}asCfsuUfcAfuCfuuucuUfcCfcAfcsUfsu | 4513 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3660 | Formula VII | 3' end of sense strand | {Phos}GfscsAfgCfuGfcUfaCfuGfgUfuCfuCfuUf | 4328 | {Phos}gsAfsgAfaCfcAfgUfaGfcAfgCfuGfcsUfsu | 4517 |
| D-3661 | Formula VII | 3' end of sense strand | {Phos}GfscsAfgCfugCfUfAfCfuGfgUfuCfuCfuUf | 4329 | {Phos}gsAfsgAfaCfcAfguagCfAfgCfuGfcsUfsu | 4518 |
| D-3662 | Formula VII | 3' end of sense strand | {Phos}gsCfsaGfcUfgCfUfAfCfuGfgUfuCfuCfuUf | 4330 | {Phos}gsAfsgAfaCfcAfguagCfaGfcUfgCfsusUf | 4519 |
| D-3663 | Formula VII | 3' end of sense strand | {Phos}GfscsAfgCfuGfcUfAfCfUfggUfuCfuCfuUf | 4331 | {Phos}gsAfsgAfaCfCfaguaGfcAfgCfuGfcsUfsu | 4520 |
| D-3664 | Formula VII | 3' end of sense strand | {Phos}GfscsAfgCfuGfcUfAfCfUfgGfuUfcUfcUfu | 4332 | {Phos}GfsasGfaAfcCfaguaGfcAfgCfuGfcsUfsu | 4521 |
| D-3665 | Formula VII | 3' end of sense strand | {Phos}GfscsAfgCfuGfCfUfAfdCuGfgUfuCfuCfuUf | 4333 | {Phos}gsAfsgAfaCfcAfguagcAfgCfuGfcsUfsu | 4522 |
| D-3666 | Formula VII | 3' end of sense strand | {Phos}GfscsAfgCfuGfCfdTAfCfuGfgUfuCfuCfuUf | 4334 | {Phos}gsAfsgAfaCfcAfguagcAfgCfuGfcsUfsu | 4522 |
| D-3667 | Formula VII | 3' end of sense strand | {Phos}GfscsAfgCfuGfcdTAfCfUfGfgUfuCfuCfuUf | 4335 | {Phos}gsAfsgAfaCfcaguaGfcAfgCfuGfcsUfsu | 4523 |
| D-3668 | Formula VII | 3' end of sense strand | {Phos}GfscsAfgCfuGfcUfAfdCUfGfgUfuCfuCfuUf | 4336 | {Phos}gsAfsgAfaCfcaguaGfcAfgCfuGfcsUfsu | 4523 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3669 | Formula VII | 3' end of sense strand | {Phos}GfscsAfgCfugCfUfadCuGfgUfuCfuCfuUf | 4337 | {Phos}gsAfsgAfaCfcAfgUfagCfAfgCfuGfcsUfsu | 4524 |
| D-3670 | Formula VII | 3' end of sense strand | {Phos}GfscsAfgCfugCfUfdACfuGfgUfuCfuCfuUf | 4338 | {Phos}gsAfsgAfaCfcAfgUfagCfAfgCfuGfcsUfsu | 4524 |
| D-3671 | Formula VII | 3' end of sense strand | {Phos}GfscsAfgCfugCfdTaCfuGfgUfuCfuCfuUf | 4339 | {Phos}gsAfsgAfaCfcAfgUfagCfAfgCfuGfcsUfsu | 4524 |
| D-3672 | Formula VII | 3' end of sense strand | {Phos}gscsagcuGfcUfadCugguucucuu | 4340 | {Phos}gsAfsgAfaCfcAfgUfaGfcAfgCfugcsusu | 4525 |
| D-3673 | Formula VII | 3' end of sense strand | {Phos}GfscsAfgCfuGfCfuAfCfuGfguucuCfuu | 4341 | {Phos}gsAfsgAfaCfcAfguagcAfgCfuGfcsUfsu | 4522 |
| D-3674 | Formula VII | 3' end of sense strand | {Phos}UfsgsUfgGfgAfaGfaAfaGfaUfgAfaGfuUf | 4342 | {Phos}csUfsuCfaUfcUfuUfcUfuCfcCfaCfasUfsu | 4526 |
| D-3675 | Formula VII | 3' end of sense strand | {Phos}UfsgsUfgGfgaAfGfAfAfaGfaUfgAfaGfuUf | 4343 | {Phos}csUfsuCfaUfcUfuucuUfCfcCfaCfasUfsu | 4527 |
| D-3676 | Formula VII | 3' end of sense strand | {Phos}usgsugggAfaGfadAagaugaaguu | 4344 | {Phos}csUfsuCfaUfcUfuUfcUfuCfcCfacasusu | 4528 |
| D-3677 | Formula VII | 3' end of sense strand | {Phos}usgsugGfgAfAfGfAfAfaGfaugaaGfuu | 4345 | {Phos}csUfsuCfaUfcUfuucuuCfcCfaCfasUfsu | 4529 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3678 | Formula VII | 3' end of sense strand | {Phos}GfuGfgGfaAfGfAfAfAfgAfuGfaAfgUfuUf | 4346 | {Phos}aCfuUfcAfuCfuuucuUfcCfcAfcUfu | 4530 |
| D-3679 | Formula VII | 3' end of sense strand | {Phos}GfcAfgCfuGfCfUfAfCfuGfgUfuCfuCfuUf | 4347 | {Phos}gAfgAfaCfcAfguagcAfgCfuGfcUfu | 4531 |
| D-3680 | Formula VII | 3' end of sense strand | {Phos}UfgUfgGfgAfAfGfAfAfaGfaUfgAfaGfuUf | 4348 | {Phos}cUfuCfaUfcUfuucuuCfcCfaCfaUfu | 4532 |
| D-3681 | Formula VII | 3' end of sense strand | {Phos}AfgGfaCfuGfUfGfCfCfcAfcUfuCfaCfuUf | 4349 | {Phos}gUfgAfaGfuGfggcacAfgUfcCfuUfu | 4533 |
| D-3682 | Formula VII | 3' end of sense strand | {Phos}GfaGfaCfgGfGfCfUfUfcAfaGfaAfcUfuUf | 4350 | {Phos}aGfuUfcUfuGfaagccCfgUfcUfcUfu | 4534 |
| D-3683 | Formula VII | 3' end of sense strand | {Phos}GfaGfcGfcAfGfCfUfGfcUfaCfuGfgUfuUf | 4351 | {Phos}aCfcAfgUfaGfcagcuGfcGfcUfcUfu | 4535 |
| D-3684 | Formula VII | 3' end of sense strand | {Phos}GfuUfgUfcUfGfUfGfUfgAfuCfgGfaUfuUf | 4352 | {Phos}aUfcCfgAfuCfacacaGfaCfaAfcUfu | 4536 |
| D-3685 | Formula VII | 3' end of sense strand | {Phos}GfgAfgCfuGfCfGfGfGfgCfcUfgAfgAfuUf | 4353 | {Phos}uCfuCfaGfgCfcccgcAfgCfuCfcUfu | 4537 |
| D-3686 | Formula VII | 3' end of sense strand | {Phos}GfcCfgCfuGfGfAfAfCfgAfcGfaCfgUfuUf | 4354 | {Phos}aCfgUfcGfuCfguuccAfgCfgGfcUfu | 4538 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3687 | Formula VII | 3' end of sense strand | {Phos}GfcUfgGfgUfCfUfGfCfgAfgAfcAfgAfuUf | 4355 | {Phos}uCfuGfuCfuCfgcagaCfcCfaGfcUfu | 4539 |
| D-3688 | Formula VII | 3' end of sense strand | {Phos}GfcUfuUfcUfCfGfGfGfaAfuUfuUfcAfuUf | 4356 | {Phos}uGfaAfaAfuUfcccgaGfaAfaGfcUfu | 4540 |
| D-3689 | Formula VII | 3' end of sense strand | {Phos}CfcUfcCfuGfCfUfGfCfuUfgUfgGfuUfuUf | 4357 | {Phos}aAfcCfaCfaAfgcagcAfgGfaGfgUfu | 4541 |
| D-3690 | Formula VII | 3' end of sense strand | {Phos}CfuAfuCfaUfGfAfCfCfaAfgGfaGfuAfuUf | 4358 | {Phos}uAfcUfcCfuUfggucaUfgAfuAfgUfu | 4542 |
| D-3691 | Formula VII | 3' end of sense strand | {Phos}CfgUfcCfuGfGfGfAfGfgAfgCfaGfaAfuUf | 4359 | {Phos}uUfcUfgCfuCfcucccAfgGfaCfgUfu | 4543 |
| D-3692 | Formula VII | 3' end of sense strand | {Phos}CfuGfgGfgGfCfCfUfCfuUfcUfgCfuUfuUf | 4360 | {Phos}aAfgCfaGfaAfgaggcCfcCfcAfgUfu | 4544 |
| D-3693 | Formula VII | 3' end of sense strand | {Phos}CfcUfaUfcAfUfGfAfCfcAfaGfgAfgUfuUf | 4361 | {Phos}aCfuCfcUfuGfgucauGfaUfaGfgUfu | 4545 |
| D-3694 | Formula VII | 3' end of sense strand | {Phos}GfaUfaGfgGfUfGfAfUfgUfuCfcGfaAfuUf | 4362 | {Phos}uUfcGfgAfaCfaucacCfcUfaUfcUfu | 4546 |
| D-3695 | Formula VII | 3' end of sense strand | {Phos}GfcAfgUfuUfGfCfAfGfgUfuAfuCfaUfuUf | 4363 | {Phos}aUfgAfuAfaCfcugcaAfaCfuGfcUfu | 4547 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3696 | Formula VII | 3' end of sense strand | {Phos}GfsusGfgGfaAfgAfAfAfgAfuGfaAfgUfcGf | 4364 | {Phos}csGfsaCfuUfcAfuCfuuuCfuUfcCfcAfcsUfsu | 4548 |
| D-3697 | Formula VII | 3' end of sense strand | {Phos}GfscsAfgCfuGfcUfAfCfuGfgUfuCfuCfuCf | 4365 | {Phos}gsAfsgAfgAfaCfcAfguaGfcAfgCfuGfcsUfsu | 4549 |
| D-3698 | Formula VII | 3' end of sense strand | {Phos}UfsgsUfgGfgAfaGfAfAfaGfaUfgAfaGfuCf | 4366 | {Phos}gsAfscUfuCfaUfcUfuucUfuCfcCfaCfasUfsu | 4550 |
| D-3699 | Formula VII | 3' end of sense strand | {Phos}AfsusGfuGfgGfaAfGfAfaAfgAfuGfaAfgUf | 4367 | {Phos}asCfsuUfcAfuCfuUfucuUfcCfcAfcAfusUfsu | 4551 |
| D-3700 | Formula VII | 3' end of sense strand | {Phos}GfscsGfcAfgCfuGfCfUfaCfuGfgUfuCfuCf | 4368 | {Phos}gsAfsgAfaCfcAfgUfagcAfgCfuGfcGfcsUfsu | 4552 |
| D-3701 | Formula VII | 3' end of sense strand | {Phos}AfsasUfgUfgGfgAfAfGfaAfaGfaUfgAfaGf | 4369 | {Phos}csUfsuCfaUfcUfuUfcuuCfcCfaCfaUfusUfsu | 4553 |
| D-3702 | Formula VII | 3' end of sense strand | {Phos}GfsasCfgGfgAfcGfGfAfCfUfaCfgAfgAfuUf | 4370 | {Phos}usCfsuCfgUfaguccGfuCfcCfgUfcsUfsu | 4554 |
| D-3703 | Formula VII | 3' end of sense strand | {Phos}AfsgsCfcAfcCfuCfUfCfCfUfuUfaAfuUfuUf | 4371 | {Phos}asAfsuUfaAfaggagAfgGfuGfgCfusUfsu | 4555 |
| D-3704 | Formula VII | 3' end of sense strand | {Phos}UfsgsAfcCfuGfcGfGfAfGfCfcUfgAfgCfuUf | 4372 | {Phos}gsCfsuCfaGfgcuccGfcAfgGfuCfasUfsu | 4556 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3705 | Formula VII | 3' end of sense strand | {Phos}CfscsUfgCfuCfuCfCfCfUfGfgGfcCfuCfuUf | 4373 | {Phos}gsAfsgGfcCfcagggAfgAfgCfaGfgsUfsu | 4557 |
| D-3706 | Formula VII | 3' end of sense strand | {Phos}CfscsUfcCfuGfcUfcfUfCfCfcUfgGfgCfuUf | 4374 | {Phos}gsCfscCfaGfggagaGfcAfgGfaGfgsUfsu | 4558 |
| D-3707 | Formula VII | 3' end of sense strand | {Phos}GfscsUfgCfuAfcUfGfGfUfUfcUfcUfcGfuUf | 4375 | {Phos}csGfsaGfaGfaaccaGfuAfgCfaGfcsUfsu | 4559 |
| D-3708 | Formula VII | 3' end of sense strand | {Phos}CfscsCfaUfuCfuCfCfAfAfGfcUfuCfaGfuUf | 4376 | {Phos}csUfsgAfaGfcuuggAfgAfaUfgGfgsUfsu | 4560 |
| D-3709 | Formula VII | 3' end of sense strand | {Phos}AfscsUfgGfuUfcUfCfUfCfGfcUfcCfgGfuUf | 4377 | {Phos}csCfsgGfaGfcgagaGfaAfcCfaGfusUfsu | 4561 |
| D-3710 | Formula VII | 3' end of sense strand | {Phos}GfsasCfgGfgAfCfGfGfAfcUfaCfgAfgAfuUf | 4378 | {Phos}usCfsuCfgUfaGfuccguCfcCfgUfcsUfsu | 4562 |
| D-3711 | Formula VII | 3' end of sense strand | {Phos}AfsgsCfcAfcCfUfCfUfCfcUfuUfaAfuUfuUf | 4379 | {Phos}asAfsuUfaAfaGfgagagGfuGfgCfusUfsu | 4563 |
| D-3712 | Formula VII | 3' end of sense strand | {Phos}GfscsAfcGfaGfCfGfCfAfgCfuGfcUfaCfuUf | 4380 | {Phos}gsUfsaGfcAfgCfugcgcUfcGfuGfcsUfsu | 4564 |
| D-3713 | Formula VII | 3' end of sense strand | {Phos}GfscsGfcAfgCfUfGfCfUfaCfuGfgUfuCfuUf | 4381 | {Phos}gsAfsaCfcAfgUfagcagCfuGfcGfcsUfsu | 4565 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3714 | Formula VII | 3' end of sense strand | {Phos}AfscsGfgGfaCfGfGfAfCfuAfcGfaGfaCfuUf | 4382 | {Phos}gsUfscUfcGfuAfguccgUfcCfcGfusUfsu | 4566 |
| D-3715 | Formula VII | 3' end of sense strand | {Phos}GfscsUfcCfaCfGfUfGfAfaGfcAfgUfuCfuUf | 4383 | {Phos}gsAfsaCfuGfcUfucacgUfgGfaGfcsUfsu | 4567 |
| D-3716 | Formula VII | 3' end of sense strand | {Phos}UfsgsAfcCfuGfCfGfGfAfgCfcUfgAfgCfuUf | 4384 | {Phos}gsCfsuCfaGfgCfuccgcAfgGfuCfasUfsu | 4568 |
| D-3717 | Formula VII | 3' end of sense strand | {Phos}GfscsUfgCfgGfGfGfCfCfuGfaGfaGfaGfuUf | 4385 | {Phos}csUfscUfcUfcAfggcccCfgCfaGfcsUfsu | 4569 |
| D-3718 | Formula VII | 3' end of sense strand | {Phos}UfsusCfaCfcGfAfCfGfAfcGfgCfcGfcUfuUf | 4386 | {Phos}asGfscGfgCfcGfucgucGfgUfgAfasUfsu | 4570 |
| D-3719 | Formula VII | 3' end of sense strand | {Phos}CfscsAfcGfaCfCfAfAfAfaCfgGfgCfcCfuUf | 4387 | {Phos}gsGfsgCfcCfgUfuuuggUfcGfuGfgsUfsu | 4571 |
| D-3720 | Formula VII | 3' end of sense strand | {Phos}CfscsUfgCfuCfUfCfCfCfuGfgGfcCfuCfuUf | 4388 | {Phos}gsAfsgGfcCfcAfgggagAfgCfaGfgsUfsu | 4572 |
| D-3721 | Formula VII | 3' end of sense strand | {Phos}CfscsUfcCfuGfCfUfCfUfcCfcUfgGfgCfuUf | 4389 | {Phos}gsCfscCfaGfgGfagagcAfgGfaGfgsUfsu | 4573 |
| D-3722 | Formula VII | 3' end of sense strand | {Phos}GfsgsGfaAfgAfAfAfGfAfuGfaAfgUfcGfuUf | 4390 | {Phos}csGfsaCfuUfcAfucuuuCfuUfcCfcsUfsu | 4574 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3723 | Formula VII | 3' end of sense strand | {Phos}CfscsAfcUfuCfAfCfCfGfaCfgAfcGfgCfuUf | 4391 | {Phos}gsCfscGfuCfgUfcggugAfaGfuGfgsUfsu | 4575 |
| D-3724 | Formula VII | 3' end of sense strand | {Phos}GfscsUfgCfuAfCfUfGfGfuUfcUfcUfcGfuUf | 4392 | [{Phos}csGfsaGfaGfaAfccaguAfgCfaGfcsUfsu | 4576 |
| D-3725 | Formula VII | 3' end of sense strand | {Phos}AfsasCfgGfgCfCfCfUfGfgAfaGfuGfgGfuUf | 4393 | {Phos}csCfscAfcUfuCfcagggCfcCfgUfusUfsu | 4577 |
| D-3726 | Formula VII | 3' end of sense strand | {Phos}AfsgsCfaGfcCfGfGfAfCfgAfcUfgGfuAfuUf | 4394 | {Phos}usAfscCfaGfuCfguccgGfcUfgCfusUfsu | 4578 |
| D-3727 | Formula VII | 3' end of sense strand | {Phos}CfsusGfcGfaGfAfCfAfGfaGfcUfgGfaCfuUf | 4395 | {Phos}gsUfscCfaGfcUfcugucUfcGfcAfgsUfsu | 4579 |
| D-3728 | Formula VII | 3' end of sense strand | {Phos}GfsgsAfgGfaCfGfCfGfCfaCfcUfgGfuGfuUf | 4396 | {Phos}csAfscCfaGfgUfgcgcgUfcCfuCfcsUfsu | 4580 |
| D-3729 | Formula VII | 3' end of sense strand | {Phos}UfscsAfcGfuCfCfUfGfGfgAfgGfaGfcAfuUf | 4397 | [{Phos}usGfscUfcCfuCfccaggAfcGfuGfasUfsu | 4581 |
| D-3730 | Formula VII | 3' end of sense strand | {Phos}AfsasGfgAfcCfUfGfCfUfgCfcCfgGfuCfuUf | 4398 | {Phos}gsAfscCfgGfgCfagcagGfuCfcUfusUfsu | 4582 |
| D-3731 | Formula VII | 3' end of sense strand | {Phos}CfscsCfaUfuCfUfCfCfAfaGfcUfuCfaGfuUf | 4399 | {Phos}csUfsgAfaGfcUfuggagAfaUfgGfgsUfsu | 4583 |

TABLE 8-continued

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| GalNAc-ASGR1 siRNA Conjugates | | | | | | |
| D-3732 | Formula VII | 3' end of sense strand | {Phos}AfsusGfgGfcCfUfCfCfAfcGfaCfcAfaAfuUf | 4400 | {Phos}usUfsuGfgUfcGfuggagGfcCfcAfusUfsu | 4584 |
| D-3733 | Formula VII | 3' end of sense strand | {Phos}CfsgsAfcGfgCfCfGfCfUfgGfaAfcGfaCfuUf | 4401 | {Phos}gsUfscGfuUfcCfagcggCfcGfuCfgsUfsu | 4585 |
| D-3734 | Formula VII | 3' end of sense strand | {Phos}AfscsUfgGfuUfCfUfCfUfcGfcUfcCfgGfuUf | 4402 | {Phos}csCfsgGfaGfcGfagagaAfcCfaGfusUfsu | 4586 |
| D-3735 | Formula VII | 3' end of sense strand | {Phos}CfsgsAfcCfaAfAfAfCfGfgGfcCfcUfgGfuUf | 4403 | {Phos}csCfsaGfgGfcCfcguuuUfgGfuCfgsUfsu | 4587 |
| D-3736 | Formula VII | 3' end of sense strand | {Phos}GfsgsUfcUfgCfGfAfGfAfcAfgAfgCfuGfuUf | 4404 | {Phos}csAfsgCfuCfuGfucucgCfaGfaCfcsUfsu | 4588 |
| D-3737 | Formula VII | 3' end of sense strand | {Phos}GfaCfgGfgAfCfGfGfAfcUfaCfgAfgAfuUf | 4405 | {Phos}uCfuCfgUfaGfuccguCfcCfgUfcUfu | 4589 |
| D-3738 | Formula VII | 3' end of sense strand | {Phos}AfgCfcAfcCfUfCfUfCfcUfuUfaAfuUfuUf | 4406 | {Phos}aAfuUfaAfaGfgagagGfuGfgCfuUfu | 4590 |
| D-3739 | Formula VII | 3' end of sense strand | {Phos}UfgAfcCfuGfCfGfGfAfgCfcUfgAfgCfuUf | 4407 | {Phos}gCfuCfaGfgCfuccgcAfgGfuCfaUfu | 4591 |
| D-3740 | Formula VII | 3' end of sense strand | {Phos}CfcUfgCfuCfUfCfCfCfuGfgGfcCfuCfuUf | 4408 | {Phos}gAfgGfcCfcAfgggagAfgCfaGfgUfu | 4592 |

TABLE 8-continued

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3741 | Formula VII | 3' end of sense strand | {Phos}CfcUfcCfuGfCfUfCfUfcCfcUfgGfgCfuUf | 4409 | {Phos}gCfcCfaGfgGfagagcAfgGfaGfgUfu | 4593 |
| D-3742 | Formula VII | 3' end of sense strand | {Phos}GfcUfgCfuAfCfUfGfGfuUfcUfcUfcGfuUf | 4410 | [{Phos}cGfaGfaGfaAfccaguAfgCfaGfcUfu | 4594 |
| D-3743 | Formula VII | 3' end of sense strand | {Phos}CfcCfaUfuCfUfCfCfAfaGfcUfuCfaGfuUf | 4411 | {Phos}cUfgAfaGfcUfuggagAfaUfgGfgUfu | 4595 |
| D-3744 | Formula VII | 3' end of sense strand | {Phos}AfcUfgGfuUfCfUfCfUfcGfcUfcCfgGfuUf | 4412 | {Phos}cCfgGfaGfcGfagagaAfcCfaGfuUfu | 4596 |
| D-3745 | Formula XVI, k = 3, n = 1 | 5' end of sense strand | GfcAfgCfuGfcUfAfCfUfggUfuCfuCfsusUf | 4413 | {Phos}gsAfsgAfaCfCfaguaGfcAfgCfuGfcsUfsu | 4520 |
| D-3746 | Formula VIII | 3' end of sense strand | {Phos}GfsusGfgGfaAfgAfAfAfGfauGfaAfgUfuUf | 4414 | {Phos}asCfsuUfcAfUfcuuuCfuUfcCfcAfcsUfsu | 4597 |
| D-3747 | Formula VIII | 3' end of sense strand | {Phos}GfsusGfgGfaAfgAfAfAfGfAfuGfaAfgUfuUf | 4415 | {Phos}asCfsuUfcAfucuuuCfuUfcCfcAfcsUfsu | 4514 |
| D-3748 | Formula XVI, k = 3, n = 1 | 5' end of sense strand | GfuGfgGfaAfgAfAfAfGfAfuGfaAfgUfsusUf | 4416 | {Phos}asCfsuUfcAfucuuuCfuUfcCfcAfcsUfsu | 4514 |
| D-3749 | Formula VIII | 3' end of sense strand | {Phos}GfuGfgGfaaGfAfaAfgAfuGfaAfgUfuUf | 4417 | {Phos}aCfuUfcAfuCfuUfucUfUfcCfcAfcUfu | 4598 |

TABLE 8-continued

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| GalNAc-ASGR1 siRNA Conjugates | | | | | | |
| D-3750 | Formula XVI, k = 3, n = 1 | 5' end of sense strand | GfuGfgGfaaGfAfaAfgAfuGfaAfgUfsusUf | 4418 | {Phos}asCfsuUfcAfuCfuUfucUfUfcCfcAfcsUfsu | 4515 |
| D-3751 | Formula XVI, k = 3, n = 1 | 5' end of sense strand | GfuGfgGfaAfgAfaAfGfauGfaAfgUfsusUf | 4419 | {Phos}asCfsuUfcAfUfcuUfuCfuUfcCfcAfcsUfsu | 4599 |
| D-3752 | Formula XXVI | 5' end of sense strand | GfuGfgGfaAfgAfAfAfgAfuGfaAfgUfsusUf | 4420 | {Phos}asCfsuUfcAfuCfuuuCfuUfcCfcAfcsUfsu | 4600 |
| D-3753 | None | N/A | {Phos}GfuGfgGfaAfgAfAfAfGfAfuGfaAfgUfuUf | 4421 | {Phos}aCfuUfcAfucuuuCfuUfcCfcAfcUfu | 4601 |
| D-3754 | None | N/A | {Phos}GfuGfgGfaAfgAfaAfgAfuGfaAfguUfUf | 4422 | [{Phos}AfCfuUfcAfuCfuUfuCfuUfcCfcAfcUfu | 4602 |
| D-3755 | None | N/A | {Phos}GfuGfgGfaAfgAfAfAfGfauGfaAfgUfuUf | 4423 | {Phos}aCfuUfcAfUfcuuuCfuUfcCfcAfcUfu | 4603 |
| D-3756 | None | N/A | {Phos}GfsusGfgGfaAfgAfAfAfGfauGfaAfgUfsusUf | 4424 | {Phos}asCfsuUfcAfUfcuuuCfuUfcCfcAfcsUfsu | 4597 |
| D-3757 | None | N/A | {Phos}GfuGfgGfaAfgAfAfAfGfaUfgAfaGfuUfu | 4425 | {Phos}AfcUfuCfaUfcuuuCfuUfcCfcAfcUfu | 4604 |
| D-3758 | Formula VIII | 3' end of sense strand | {Phos}GfscsAfgCfuGfcUfAfCfUfGfgUfuCfuCfuUf | 4426 | {Phos}gsAfsgAfaCfcaguaGfcAfgCfuGfcsUfsu | 4523 |
| D-3759 | Formula VIII | 3' end of sense strand | {Phos}UfsgsUfgGfgAfaGfAfAfAfGfaUfgAfaGfuUf | 4427 | {Phos}csUfsuCfaUfcuuucUfuCfcCfaCfasUfsu | 4605 |
| D-3760 | Formula VIII | 3' end of sense strand | {Phos}GfsusGfgGfaaGfAfaAfgAfuGfaAfgUfuUf | 4428 | {Phos}asCfsuUfcAfuCfuUfucUfUfcCfcAfcsUfsu | 4515 |
| D-3761 | Formula VIII | 3' end of sense strand | {Phos}GfscsAfgCfugCfUfaCfuGfgUfuCfuCfuUf | 4429 | {Phos}gsAfsgAfaCfcAfgUfagCfAfgCfuGfcsUfsu | 4524 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3762 | Formula VIII | 3' end of sense strand | {Phos}GfsusGfgGfaAfgAfaAfgAfuGfaAfgUfuUf | 4430 | {Phos}asCfsuUfcAfuCfuUfuCfuUfcCfcAfcsUfsUf | 4606 |
| D-3763 | Formula VIII | 3' end of sense strand | {Phos}GfsusGfgGfaAfgAfaAfGfauGfaAfgUfuUf | 4431 | {Phos}asCfsuUfcAfUfcuUfuCfuUfcCfcAfcsUfsu | 4599 |
| D-3764 | Formula VIII | 3' end of sense strand | {Phos}GfsusGfggAfAfgAfaAfgAfuGfaAfgUfuUf | 4432 | {Phos}asCfsuUfcAfuCfuUfuCfuuCfCfcAfcsUfsu | 4607 |
| D-3765 | Formula VIII | 3' end of sense strand | {Phos}GfsusgGfGfaAfgAfaAfgAfuGfaAfgUfuUf | 4433 | {Phos}asCfsuUfcAfuCfuUfuCfuUfccCfAfcsUfsu | 4608 |
| D-3766 | Formula VIII | 3' end of sense strand | {Phos}gsUfsGfgGfaAfgAfaAfgAfuGfaAfgUfuUf | 4434 | {Phos}asCfsuUfcAfuCfuUfuCfuUfcCfcaCfsUfsUf | 4609 |
| D-3767 | Formula XVI, k = 3, n = 1 | 5' end of sense strand | GfuGfgGfaAfgAfaAfgAfUfgaAfgUfsusUf | 4435 | {Phos}asCfsuUfCfauCfuUfuCfuUfcCfcAfcsUfsu | 4610 |
| D-3768 | Formula XVI, k = 3 n = 1 | 5' end of sense strand | GfuGfgGfaAfgAfaAfgAfuGfAfagUfsusUf | 4436 | {Phos}asCfsUfucAfuCfuUfuCfuUfcCfcAfcsUfsu | 4611 |
| D-3769 | Formula XVI, k = 3, n = 1 | 5' end of sense strand | GfuGfgGfaAfgAfaAfgAfuGfaAfGfususUf | 4437 | {Phos}AfscsuUfcAfuCfuUfuCfuUfcCfcAfcsUfsu | 4612 |
| D-3770 | Formula XVI, k = 3, n = 1 | 5' end of sense strand | gUfgGfgAfaGfAfAfAfgAfuGfaAfgUfsusUf | 4438 | {Phos}asCfsuUfcAfuCfuuucUfuCfcCfaCfsusUf | 4613 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3771 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcsUfsu | 4597 |
| D-3772 | Formula XVI, k = 3, n = 1 | 5' end of sense strand | GfuGfgGfaAfgAfAfAfGfaUfgAfaGfusUfsu | 4440 | {Phos}AfscsUfuCfaUfcuuuCfuUfcCfcAfcsUfsu | 4614 |
| D-3773 | Formula XVI, k = 3, n = 1 | 5' end of sense strand | GfcAfgCfuGfcUfAfCfUfGfgUfuCfuCfsusUf | 4441 | {Phos}gsAfsgAfaCfcaguaGfcAfgCfuGfcsUfsu | 4523 |
| D-3774 | Formula XXIX | 3' end of sense strand | {Phos}GfsusGfgGfaAfgAfAfAfGfauGfaAfgUfuUf | 4414 | {Phos}asCfsuUfcAfUfcuuuCfuUfcCfcAfcsUfsu | 4597 |
| D-3775 | Formula XXIX | 3' end of sense strand | {Phos}GfsusGfgGfaAfgAfaAfGfauGfaAfgUfuUf | 4431 | {Phos}asCfsuUfcAfUfcuUfuCfuUfcCfcAfcsUfsu | 4599 |
| D-3776 | None | N/A | {Phos}GfscsAfgCfugCfUfaCfuGfgUfuCfuCfuUf | 4429 | {Phos}gsAfsgAfaCfcAfgUfagCfAfgCfuGfcsUfsUf | 4615 |
| D-3777 | None | N/A | {Phos}GfscsAfgCfuGfcUfAfCfUfGfgUfuCfuCfuUf | 4426 | {Phos}gsAfsgAfaCfcaguaGfcAfgCfuGfcsUfsUf | 4616 |
| D-3778 | Formula VIII | 3' end of sense strand | {Phos}GfscsAfgCfuGfcUfaCfugGfUfuCfuCfuUf | 4442 | {Phos}gsAfsgAfacCfAfgUfaGfcAfgCfuGfcsUfsu | 4617 |
| D-3779 | Formula XVI, k = 3, n = 1 | 5' end of sense strand | GfcCfgCfuGfgAfAfCfGfacGfaCfgUfsusUf | 4443 | {Phos}asCfsgUfcGfUfcguuCfcAfgCfgGfcsUfsu | 4618 |
| D-3780 | Formula XVI, k = 3, n = 1 | 5' end of sense strand | GfaUfaGfgGfuGfAfUfGfuuCfcGfaAfsusUf | 4444 | [{Phos}usUfscGfgAfAfcaucAfcCfcUfaUfcsUfsu | 4619 |
| D-3781 | Formula XVI, k = 3, | 5' end of | CfcUfaUfcAfuGfAfCfCfaaGfgAfgUfsusUf | 4445 | {Phos}asCfsuCfcUfUfggucAfuGfaUfaGfgsUfsu | 4620 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| | n = 1 | sense strand | | | | |
| D-3782 | Formula XVI, k = 3, n = 1 | 5' end of sense strand | CfuAfuCfaUfgAfCfCfAfagGfaGfuAfsusUf | 4446 | {Phos}usAfscUfcCfUfugguCfaUfgAfuAfgsUfsu | 4621 |
| D-3783 | Formula XVI, k = 3, n = 1 | 5' end of sense strand | AfaCfgGfgCfcCfUfGfGfaaGfuGfgGfsusUf | 4447 | {Phos}csCfscAfcUfUfccagGfgCfcCfgUfusUfsu | 4622 |
| D-3784 | Formula XVI, k = 3, n = 1 | 5' end of sense strand | GfaCfgGfgAfcGfGfAfCfuaCfgAfgAfsusUf | 4448 | {Phos}usCfsuCfgUfAfguccGfuCfcCfgUfcsUfsu | 4623 |
| D-3785 | Formula XVI, k = 3, n = 1 | 5' end of sense strand | AfcGfgGfaCfgGfAfCfUfacGfaGfaCfsusUf | 4449 | {Phos}gsUfscUfcGfUfagucCfgUfcCfcGfusUfsu | 4624 |
| D-3786 | Formula XVI, k = 3, n = 1 | 5' end of sense strand | AfgCfaGfcCfgGfAfCfGfacUfgGfuAfsusUf | 4450 | {Phos}usAfscCfaGfUfcgucCfgGfcUfgCfusUfsu | 4625 |
| D-3787 | Formula XVI, k = 3, n = 1 | 5' end of sense strand | CfcAfcUfuCfaCfCfGfAfcgAfcGfgCfsusUf | 4451 | {Phos}gsCfscGfuCfGfucggUfgAfaGfuGfgsUfsu | 4626 |
| D-3788 | Formula XVI, k = 3, n = 1 | 5' end of sense strand | CfgAfcGfgCfcGfCfUfGfgaAfcGfaCfsusUf | 4452 | [{Phos}gsUfscGfuUfCfcagcGfgCfcGfuCfgsUfsu | 4627 |
| D-3789 | Formula XVI, k = 3, n = 1 | 5' end of sense strand | AfaAfcCfcGfuGfGfCfGfcuUfuCfuGfsusUf | 4453 | {Phos}csAfsgAfaAfGfcgccAfcGfgGfuUfusUfsu | 4628 |
| D-3790 | Formula XVI, k = 3, n = 1 | 5' end of sense strand | CfcUfcUfuCfuGfCfUfUfucUfcGfgGfsusUf | 4454 | {Phos}csCfscGfaGfAfaagcAfgAfaGfaGfgsUfsu | 4629 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3791 | Formula XVI, k = 3, n = 1 | 5' end of sense strand | GfaAfaCfcCfgUfGfGfCfgcUfuUfcUfsusUf | 4455 | {Phos}asGfsaAfaGfCfgccaCfgGfgUfuUfcsUfsu | 4630 |
| D-3792 | Formula XVI, k = 3, n = 1 | 5' end of sense strand | GfcAfgAfaAfuUfUfGfUfccAfgCfaCfsusUf | 4456 | {Phos}gsUfsgCfuGfGfacaaAfuUfuCfuGfcsUfsu | 4631 |
| D-3793 | Formula XVI, k = 3, n = 1 | 5' end of sense strand | GfgAfcUfaCfgAfGfAfCfggGfcUfuCfsusUf | 4457 | {Phos}gsAfsaGfcCfCfgucuCfgUfaGfuCfcsUfsu | 4632 |
| D-3794 | Formula XVI, k = 3, n = 1 | 5' end of sense strand | GfuGfcCfcAfcUfUfCfAfccGfaCfgAfsusUf | 4458 | {Phos}usCfsgUfcGfGfugaaGfuGfgGfcAfcsUfsu | 4633 |
| D-3795 | Formula XVI, k = 3, n = 1 | 5' end of sense strand | GfuUfgUfcUfgUfGfUfGfauCfgGfaUfsusUf | 4459 | {Phos}asUfscCfgAfUfcacaCfaGfaCfaAfcsUfsu | 4634 |
| D-3796 | Formula XVI, k = 3, n = 1 | 5' end of sense strand | GfgUfcUfgCfgAfGfAfCfagAfgCfuGfsusUf | 4460 | {Phos}csAfsgCfuCfUfgucuCfgCfaGfaCfcsUfsu | 4635 |
| D-3797 | Formula XVI, k = 3, n = 1 | 5' end of sense strand | AfgCfcAfcCfuCfUfCfCfuuUfaAfuUfsusUf | 4461 | {Phos}asAfsuUfaAfAfggagAfgGfuGfgCfusUfsu | 4636 |
| D-3798 | Formula XVI, k = 3, n = 1 | 5' end of sense strand | GfcUfcCfaCfgUfGfAfAfgcAfgUfuCfsusUf | 4462 | {Phos}gsAfsaCfuGfCfuucaCfgUfgGfaGfcsUfsu | 4637 |
| D-3799 | Formula XVI, k = 3, n = 1 | 5' end of sense strand | GfcGfcAfgCfuGfCfUfAfcuGfgUfuCfsusUf | 4463 | {Phos}gsAfsaCfcAfGfuagcAfgCfuGfcGfcsUfsu | 4638 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3800 | Formula XVI, k = 3, n = 1 | 5' end of sense strand | GfcUfgCfuAfcUfGfGfUfucUfcUfcGfsusUf | 4464 | {Phos}csGfsaGfaGfAfaccaGfuAfgCfaGfcsUfsu | 4639 |
| D-3801 | Formula XVI, k = 3, n = 1 | 5' end of sense strand | AfcUfgGfuUfcUfCfUfCfgcUfcCfgGfsusUf | 4465 | {Phos}csCfsgGfaGfCfgagaGfaAfcCfaGfusUfsu | 4640 |
| D-3802 | Formula VIII | 3' end of sense strand | {Phos}GfcAfgCfuGfcUfAfCfUfGfgUfuCfuCfuUf | 4466 | {Phos}gAfgAfaCfcaguaGfcAfgCfuGfcUfu | 4641 |
| D-3803 | Formula VIII | 3' end of sense strand | GfscsAfgCfuGfcUfAfCfUfGfgUfuCfuCfuUf | 4467 | gsAfsgAfaCfcaguaGfcAfgCfuGfcsUfsu | 4642 |
| D-3804 | Formula XVI, k = 3, n = 1 | 5' end of sense strand | GfcAfGCfUGfcUfAfCfUfGfGUfUCfUCfUUf | 4468 | {Phos}GAfGAfACfcAGUAGfcAfGCfUGfcUfu | 4643 |
| D-3805 | Formula VIII | 3' end of sense strand | {Phos}gsUfsgGfgAfaGfAfaAfgAfuGfaAfgUfuUf | 4469 | {Phos}asCfsuUfcAfuCfuUfucUfuCfcCfaCfsusUf | 4644 |
| D-3806 | Formula XVI, k = 3, n = 1 | 5' end of sense strand | gUfgGfgAfaGfAfaAfgAfuGfaAfgUfsusUf | 4470 | {Phos}asCfsuUfcAfuCfuUfucUfuCfcCfaCfsusUf | 4644 |
| D-3807 | Formula XVI, k = 3, n = 1 | 5' end of sense strand | gUfgGfgAfagAfaAfgAfuGfaAfgUfsusUf | 4471 | {Phos}asCfsuUfcAfuCfuUfuCfUfuCfcCfaCfsusUf | 4645 |
| D-3808 | Formula XVI, k = 3, n = 1 | 5' end of sense strand | AfuGfgGfcCfuCfCfAfCfgaCfcAfaAfsusUf | 4472 | {Phos}usUfsuGfgUfCfguggAfgGfcCfcAfusUfsu | 4646 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3809 | Formula XVI, k = 3, n = 1 | 5' end of sense strand | GfcAfcGfaGfcGfCfAfGfcuGfcUfaCfsusUf | 4473 | {Phos}gsUfsaGfcAfGfcugcGfcUfcGfuGfcsUfsu | 4647 |
| D-3810 | Formula XVI, k = 3, n = 1 | 5' end of sense strand | UfuCfaCfcGfaCfGfAfCfggCfcGfcUfsusUf | 4474 | {Phos}asGfscGfgCfCfgucgUfcGfgUfgAfasUfsu | 4648 |
| D-3811 | Formula XVI, k = 3, n = 1 | 5' end of sense strand | GfaAfgUfgGfgUfGfGfAfcgGfgAfcGfsusUf | 4475 | [{Phos}csGfsuCfcCfGfuccaCfcCfaCfuUfcsUfsu | 4649 |
| D-3812 | Formula XVI, k = 3, n = 1 | 5' end of sense strand | UfcAfcGfuCfcUfGfGfGfagGfaGfcAfsusUf | 4476 | {Phos}usGfscUfcCfUfcccaGfgAfcGfuGfasUfsu | 4650 |
| D-3813 | Formula XVI, k = 3, n = 1 | 5' end of sense strand | GfuGfgGfaAfgAfAfAfGfauGfaAfgUfuUfs{invAb} | 4477 | {Phos}asCfsuUfcAfUfcuuuCfuUfcCfcAfcsUfsu | 4597 |
| D-3814 | Formula XVI, k = 3, n = 1 | 5' end of sense strand | [invAb]GfuGfgGfaAfgAfAfAfGfauGfaAfgUfsusUf | 4478 | {Phos}asCfsuUfcAfUfcuuuCfuUfcCfcAfcsUfsu | 4597 |
| D-3815 | Formula XVI, k = 3, n = 1 | 5' end of sense strand | [invAb]GfuGfgGfaAfgAfAfAfGfauGfaAfgUfuUfs{i nvAb} | 4479 | {Phos}asCfsuUfcAfUfcuuuCfuUfcCfcAfcsUfsu | 4597 |
| D-3816 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcUfus{in vAb} | 4651 |
| D-3817 | Formula XVI, k = 3, n = 1 | 5' end of sense strand | GfsusGfgGfaAfgAfAfAfGfauGfaAfgUfsusUf | 4480 | {Phos}asCfsuUfcAfUfcuuuCfuUfcCfcAfcsUfsu | 4597 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3818 | Formula XVI, k = 3, n = 1 | 5' end of sense strand | GfsusGfsgGfaAfgAfAfAfGfauGfaAfgUfsusUf | 4481 | {Phos}asCfsuUfcAfUfcuuuCfuUfcCfcAfcsUfsu | 4597 |
| D-3819 | Formula XVI, k = 3, n = 1 | 5' end of sense strand | GfuGfgGfaAfgAfAfAfGfauGfaAfgsUfsusUf | 4482 | {Phos}asCfsuUfcAfUfcuuuCfuUfcCfcAfcsUfsu | 4597 |
| D-3820 | Formula XVI, k = 3, n = 1 | 5' end of sense strand | GfuGfgGfaAfgAfAfAfGfauGfaAfgUfusUf | 4483 | {Phos}asCfsuUfcAfUfcuuuCfuUfcCfcAfcsUfsu | 4597 |
| D-3821 | Formula XVI, k = 3 n = 1 | 5' end of sense strand | GfuGfgGfaAfgAfAfAfGfauGfaAfgUfsusUf | 4439 | [{Phos}asCfsusUfcAfUfcuuuCfuUfcCfcAfcsUfsu | 4652 |
| D-3822 | Formula XVI, k = 3, n = 1 | 5' end of sense strand | GfuGfgGfaAfgAfAfAfGfauGfaAfgUfsusUf | 4439 | {Phos}asCfuUfcAfUfcuuuCfuUfcCfcAfcsUfsu | 4653 |
| D-3823 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfscsUfsu | 4654 |
| D-3824 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcUfsu | 4655 |
| D-3825 | Formula XVI, k = 3, n = 1 | 5' end of sense strand | GfuGfgGfaAfgAfAfAfGfauGfaAfgUfuUf | 4484 | {Phos}asCfsuUfcAfUfcuuuCfuUfcCfcAfcsUfsu | 4597 |
| D-3826 | Formula XVI, k = 3, n = 1 | 5' end of sense strand | GfuGfgGfaAfgAfAfAfGfauGfaAfgUfsusUf | 4439 | {Phos}aCfuUfcAfUfcuuuCfuUfcCfcAfcsUfsu | 4656 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3827 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcUfu | 4657 |
| D-3828 | Formula XVI, k = 3, n = 1 | 5' end of sense strand | CfcGfcUfgGfaAfCfGfAfcgAfcGfuCfsusUf | 4485 | {Phos}gsAfscGfuCfGfucguUfcCfaGfcGfgsUfsu | 4658 |
| D-3829 | Formula XVI, k = 3, n = 1 | 5' end of sense strand | GfaUfgCfcAfcGfUfUfUfggCfgUfgCfsusUf | 4486 | {Phos}gsCfsaCfgCfCfaaacGfuGfgCfaUfcsUfsu | 4659 |
| D-3830 | Formula XVI, k = 3, n = 1 | 5' end of sense strand | GfaGfcAfcCfcAfGfGfGfagGfcAfaUfsusUf | 4487 | {Phos}asUfsuGfcCfUfcccuGfgGfuGfcUfcsUfsu | 4660 |
| D-3831 | Formula XVI, k = 3, n = 1 | 5' end of sense strand | GfgCfuUfgAfgCfAfCfCfcaGfgGfaGfsusUf | 4488 | {Phos}csUfscCfcUfGfggugCfuCfaAfgCfcsUfsu | 4661 |
| D-3832 | Formula XVI, k = 3, n = 1 | 5' end of sense strand | GfaAfgAfaAfgAfUfGfAfagUfcGfcUfsusUf | 4489 | {Phos}asGfscGfaCfUfucauCfuUfuCfuUfcsUfsu | 4662 |
| D-3833 | Formula XVI, k = 3, n = 1 | 5' end of sense strand | GfaGfaUfgCfcAfCfGfUfuuGfgCfgUfsusUf | 4490 | {Phos}asCfsgCfcAfAfacguGfgCfaUfcUfcsUfsu | 4663 |
| D-3834 | Formula XVI, k = 3, n = 1 | 5' end of sense strand | CfgGfgAfcGfgAfCfUfAfcgAfgAfcGfsusUf | 4491 | {Phos}csGfsuCfuCfGfuaguCfcGfuCfcCfgsUfsu | 4664 |
| D-3835 | Formula XVI, k = 3, n = 1 | 5' end of sense strand | CfuAfcGfaGfaCfGfGfGfcuUfcAfaGfsusUf | 4492 | {Phos}csUfsuGfaAfGfcccgUfcUfcGfuAfgsUfsu | 4665 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3836 | Formula XVI, k = 3, n = 1 | 5' end of sense strand | CfcCfgGfgCfaCfUfGfGfagAfuGfcCfsusUf | 4493 | {Phos}gsGfscAfuCfUfccagUfgCfcCfgGfgsUfsu | 4666 |
| D-3837 | Formula XVI, k = 3 n = 1 | 5' end of sense strand | UfgAfaAfcCfcGfUfGfGfcgCfuUfuCfsusUf | 4494 | {Phos}gsAfsaAfgCfGfccacGfgGfuUfuCfasUfsu | 4667 |
| D-3838 | Formula XVI, k = 3 n = 1 | 5' end of sense strand | GfgUfgGfuCfaCfGfUfCfcuGfgGfaGfsusUf | 4495 | {Phos}csUfscCfcAfGfgcsgUfgAfcCfaCfcsUfsu | 4668 |
| D-3839 | Formula XVI, k = 3, n = 1 | 5' end of sense strand | CfaGfaAfaUfuUfGfUfCfcaGfcAfcCfsusUf | 4496 | {Phos}gsGfsuGfcUfGfgacaAfaUfuUfcUfgsUfsu | 4669 |
| D-3840 | Formula XVI, k = 3, n = 1 | 5' end of sense strand | AfuGfcCfaCfgUfUfUfGfgcGfuGfcUfsusUf | 4497 | {Phos}asGfscAfcGfCfcaaaCfgUfgGfcAfusUfsu | 4670 |
| D-3841 | Formula XVI, k = 3, n = 1 | 5' end of sense strand | AfgCfuGfcGfgGfGfCfCfugAfgAfgAfsusUf | 4498 | {Phos}usCfsuCfuCfAfggccCfcGfcAfgCfusUfsu | 4671 |
| D-3842 | Formula XVI, k = 3, n = 1 | 5' end of sense strand | GfcCfcUfaUfcAfUfGfAfccAfaGfgAfsusUf | 4499 | {Phos}usCfscUfuGfGfucauGfaUfaGfgGfcsUfsu | 4672 |
| D-3843 | Formula XVI, k = 3 n = 1 | 5' end of sense strand | AfgCfaAfcUfuCfAfCfAfgcGfaGfcAfsusUf | 4500 | {Phos}usGfscUfcGfCfugugAfaGfuUfgCfusUfsu | 4673 |
| D-3844 | Formula XVI, k = 3, n = 1 | 5' end of sense strand | AfgCfaGfaAfaUfUfUfGfucCfaGfcAfsusUf | 4501 | {Phos}usGfscUfgGfAfcaaaUfuUfcUfgCfusUfsu | 4674 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3845 | Formula XVI, k = 3, n = 1 | 5' end of sense strand | AfaAfaCfgGfgCfCfCfUfggAfaGfuGfsusUf | 4502 | {Phos}csAfscUfuCfCfagggCfcCfgUfuUfusUfsu | 4675 |
| D-3846 | Formula XVI, k = 3, n = 1 | 5' end of sense strand | GfcCfuGfaGfcUfGfUfCfagAfuGfgCfsusUf | 4503 | {Phos}gsCfscAfuCfUfgacaGfcUfcAfgGfcsUfsu | 4676 |
| D-3847 | Formula XVI, k = 3, n = 1 | 5' end of sense strand | UfgGfaGfaUfgCfCfAfCfguUfuGfgCfsusUf | 4504 | {Phos}gsCfscAfaAfCfguggCfaUfcUfcCfasUfsu | 4677 |
| D-3848 | Formula XVI, k = 3, n = 1 | 5' end of sense strand | AfcUfaCfgAfgAfCfGfGfgcUfuCfaAfsusUf | 4505 | {Phos}usUfsgAfaGfCfccguCfuCfgUfaGfusUfsu | 4678 |
| D-3849 | Formula XVI, k = 3, n = 1 | 5' end of sense strand | AfaGfuGfgGfuGfGfAfCfggGfaCfgGfsusUf | 4506 | {Phos}csCfsgUfcCfCfguccAfcCfcAfcUfusUfsu | 4679 |
| D-3850 | Formula XVI, k = 3, n = 1 | 5' end of sense strand | UfgCfaCfaGfcAfCfUfGfaaGfaAfcCfsusUf | 4507 | {Phos}gsGfsuUfcUfUfcaguGfcUfgUfgCfasUfsu | 4680 |
| D-3851 | Formula XVI, k = 3, n = 1 | 5' end of sense strand | AfcGfgAfcUfaCfGfAfGfacGfgGfcUfsusUf | 4508 | {Phos}asGfscCfcGfUfcucgUfaGfuCfcGfusUfsu | 4681 |
| D-3852 | Formula XVI, k = 3, n = 1 | 5' end of sense strand | GfgAfcGfaCfuGfGfUfAfcgGfcCfaCfsusUf | 4509 | {Phos}gsUfsgGfcCfGfuaccAfgUfcGfuCfcsUfsu | 4682 |
| D-3853 | Formula XVI, k = 3, n = 1 | 5' end of sense strand | GfaGfcUfgCfgGfGfGfCfcuGfaGfaGfsusUf | 4510 | {Phos}csUfscUfcAfGfgcccCfgCfaGfcUfcsUfsu | 4683 |

TABLE 8-continued

| GalNAc-ASGR1 siRNA Conjugates | | | | | | |
|---|---|---|---|---|---|---|
| Duplex No. | GalNAc Moiety | Site of GalNAc Moiety Conjug. | Sense Sequence (5'-3') | SEQ ID NO: | Antisense Sequence (5'-3') | SEQ ID NO: |
| D-3854 | Formula XVI, k = 3, n = 1 | 5' end of sense strand | CfaCfgUfuUfgGfCfGfUfgcUfuGfgAfsusUf | 4511 | {Phos}usCfscAfaGfCfacgcCfaAfaCfgUfgsUfsu | 4684 |
| D-3855 | Formula XVI, k = 3, n = 1 | 5' end of sense strand | GfuGfgGfaAfgAfAfAfGfauGfaAfgUfsusUf | 4439 | {Phos}[invAbs]asCfsuUfcAfUfcuuuCfuUfcCfcAfcsUfsu | 4685 |
| D-3856 | Formula XVI, k = 3, n = 1 | 5' end of sense strand | GfuGfgGfaAfgAfAfAfGfauGfaAfgUfsusUf | 4439 | {Phos}[invAbs]asCfsuUfcAfUfcuuuCfuUfcCfcAfcUfus{invAb} | 4686 |
| D-3857 | Formula XVI, k = 3, n = 1 | 5' end of sense strand | GfuGfgGfaaGfAfAfAfgAfuGfaAfgUfsusUf | 4512 | {Phos}asCfsuUfcAfuCfuuucUfUfcCfcAfcsUfsu | 4687 |

The efficacy of the GalNAc-siRNA conjugates for inhibiting ASGR1 expression was tested in the Hep3B cell transfection immunoassay (described in Example 2) and/or the human ASGR1 CHO cell free uptake immunoassay (described in Example 7). The results of the assays are shown in Table 9 below.

TABLE 9

Efficacy of GalNAc-ASGRI siRNA conjugates in vitro

| Target site of antisense sequence within NM_ 001671.4 | Target site of antisense sequence within NM_ 1197216.2 | Duplex No. | Hep3B Trans-fected IC50 IP (μM) | Hep3B Trans-fected Max Anta-gonist Activity | hASGR1 CHO Free Uptake IC50 IP (μM) | hASGR1 CHO Free Uptake Max Anta-gonist Activity |
|---|---|---|---|---|---|---|
| 692-710 | 575-593 | D-3651 | 0.00141 | −0.90 | >0.5 | −0.51 |
| 692-710 | 575-593 | D-3652 | 0.00239 | −0.97 | >0.5 | −0.34 |
| 692-710 | 575-593 | D-3653 | 0.00115 | −0.84 | >0.5 | −0.42 |
| 692-710 | 575-593 | D-3654 | 0.00206 | −0.89 | >0.5 | −0.32 |
| 692-710 | 575-593 | D-3655 | 0.00461 | −0.77 | >0.5 | −0.15 |
| 692-710 | 575-593 | D-3656 | 0.00476 | −0.97 | >0.5 | −0.13 |
| 692-710 | 575-593 | D-3657 | 0.00431 | −0.83 | >0.5 | −0.10 |
| 692-710 | 575-593 | D-3658 | 0.00231 | −0.96 | >0.5 | −0.35 |
| 692-710 | 575-593 | D-3659 | 0.00177 | −0.90 | >0.5 | −0.48 |
| 888-906 | 771-789 | D-3660 | 0.00398 | −0.62 | >0.5 | −0.04 |
| 888-906 | 771-789 | D-3661 | >12.5 | −0.4 | >25.0 | −0.30 |
| 888-906 | 771-789 | D-3662 | >12.5 | 0.0 | >25.0 | −0.10 |
| 888-906 | 771-789 | D-3663 | 0.00309 | −0.9 | >25.0 | −0.20 |
| 888-906 | 771-789 | D-3664 | 0.00229 | −0.7 | >25.0 | 0.10 |
| 888-906 | 771-789 | D-3665 | 0.000862 | −0.7 | >25.0 | 0.00 |
| 888-906 | 771-789 | D-3666 | 0.000545 | −0.8 | >25.0 | 0.10 |
| 888-906 | 771-789 | D-3667 | 0.000716 | −0.8 | >25.0 | 0.10 |
| 888-906 | 771-789 | D-3668 | 0.00358 | −0.8 | >25.0 | 0.10 |
| 888-906 | 771-789 | D-3669 | >12.5 | −0.5 | >25.0 | −0.10 |
| 888-906 | 771-789 | D-3670 | >12.5 | −0.3 | >25.0 | 0.10 |
| 888-906 | 771-789 | D-3671 | >12.5 | −0.1 | >25.0 | −0.10 |
| 888-906 | 771-789 | D-3672 | 0.00156 | −0.7 | >25.0 | 0.10 |
| 888-906 | 771-789 | D-3673 | >12.5 | −0.2 | >25.0 | −0.20 |
| 691-709 | 574-592 | D-3674 | 0.59834 | −0.9 | >25.0 | −0.10 |
| 691-709 | 574-592 | D-3675 | 1 | −0.5 | >25.0 | −0.10 |
| 691-709 | 574-592 | D-3676 | 0.24304 | −0.7 | >25.0 | −0.10 |
| 691-709 | 574-592 | D-3677 | 1.99 | −0.9 | >25.0 | −0.30 |
| 692-710 | 575-593 | D-3678 | 0.0085575 | −1.0 | 1.26 | −0.40 |
| 888-906 | 771-789 | D-3679 | 0.33276 | −0.8 | 0.00324 | −0.20 |
| 691-709 | 574-592 | D-3680 | 0.079157 | −1.0 | >12.5 | 0.00 |
| 1158-1176 | 1041-1059 | D-3681 | 0.02749 | −0.8 | >12.5 | −0.20 |
| 1088-1106 | 971-989 | D-3682 | 0.0064167 | −1.0 | 9.4 | −0.30 |
| 884-902 | 767-785 | D-3683 | 0.0057367 | −0.9 | >12.5 | −0.30 |
| 563-581 | — | D-3684 | 0.18997 | −1.0 | 5.48 | −0.20 |
| 604-622 | 487-505 | D-3685 | 0.070325 | −0.9 | 0.306 | −0.10 |
| 1185-1203 | 1068-1086 | D-3686 | 0.25317 | −0.9 | >12.5 | −0.10 |
| 1221-1239 | 1104-1122 | D-3687 | 0.012227 | −0.9 | >12.5 | 0.10 |
| 1349-1367 | 1232-1250 | D-3688 | 0.002845 | −1.0 | >12.5 | −0.20 |
| 547-565 | — | D-3689 | 0.009105 | −0.8 | >12.5 | −0.20 |
| 396-414 | 396-414 | D-3690 | 0.003015 | −1.0 | >12.5 | 0.10 |
| 978-996 | 861-879 | D-3691 | 0.24201 | −0.9 | >12.5 | 0.10 |
| 1334-1352 | 1217-1235 | D-3692 | 0.10186 | −0.9 | >12.5 | −0.10 |
| 395-413 | 395-413 | D-3693 | 0.081347 | −0.9 | >12.5 | −0.10 |
| 1393-1411 | 1276-1294 | D-3694 | 0.58738 | −1.0 | >12.5 | 0.10 |
| 1443-1461 | 1326-1344 | D-3695 | 0.015662 | −0.9 | >12.5 | 0.20 |
| 692-710 | 575-593 | D-3696 | >12.5 | 0.1 | >25.0 | −0.30 |
| 888-906 | 771-789 | D-3697 | 0.00389 | −0.7 | >25.0 | 0.00 |
| 691-709 | 574-592 | D-3698 | >12.5 | −0.2 | >25.0 | −0.10 |
| 692-710 | 575-593 | D-3699 | 0.00324 | −0.9 | 0.638 | −0.40 |
| 888-906 | 771-789 | D-3700 | >12.5 | −0.6 | >25.0 | 0.10 |
| 691-709 | 574-592 | D-3701 | >12.5 | −0.5 | >25.0 | 0.10 |
| 1073-1091 | 956-974 | D-3702 | 0.009365 | −0.8 | >12.5 | −0.30 |
| 1260-1278 | 1143-1161 | D-3703 | >0.195 | −0.4 | >12.5 | −0.20 |
| 796-814 | 679-697 | D-3704 | >12.5 | −0.3 | >12.5 | 0.20 |
| 526-544 | — | D-3705 | >12.5 | −0.2 | >12.5 | −0.10 |
| 523-541 | — | D-3706 | >12.5 | −0.2 | >12.5 | −0.20 |
| 891-909 | 774-792 | D-3707 | 0.00932 | −0.6 | >12.5 | −0.20 |
| 288-306 | 288-306 | D-3708 | 2.22 | −0.5 | >12.5 | 0.20 |
| 897-915 | 780-798 | D-3709 | 0.0129 | −0.8 | >12.5 | −0.20 |
| 1073-1091 | 956-974 | D-3710 | 0.00656 | −0.9 | >12.5 | −0.20 |
| 1260-1278 | 1143-1161 | D-3711 | >12.5 | −0.2 | >12.5 | −0.10 |
| 880-898 | 763-781 | D-3712 | 0.00684 | −0.6 | >12.5 | −0.20 |
| 886-904 | 769-787 | D-3713 | 0.0102 | −0.7 | >12.5 | −0.20 |
| 1074-1092 | 957-975 | D-3714 | 0.005445 | −0.8 | >12.5 | −0.30 |
| 772-790 | 655-673 | D-3715 | >12.5 | −0.2 | >12.5 | −0.20 |

TABLE 9-continued

Efficacy of GalNAc-ASGRI siRNA conjugates in vitro

| Target site of antisense sequence within NM_ 001671.4 | Target site of antisense sequence within NM_ 1197216.2 | Duplex No. | Hep3B Trans-fected IC50 IP (μM) | Hep3B Trans-fected Max Anta-gonist Activity | hASGR1 CHO Free Uptake IC50 IP (μM) | hASGR1 CHO Free Uptake Max Anta-gonist Activity |
|---|---|---|---|---|---|---|
| 796-814 | 679-697 | D-3716 | 12.5 | −0.3 | >12.5 | −0.40 |
| 607-625 | 490-508 | D-3717 | >12.5 | −0.3 | >12.5 | −0.20 |
| 1172-1190 | 1055-1073 | D-3718 | >12.5 | 0.0 | >12.5 | −0.20 |
| 1042-1060 | 925-943 | D-3719 | >0.0488 | −0.6 | >12.5 | −0.20 |
| 526-544 | — | D-3720 | >12.5 | −0.2 | >12.5 | −0.10 |
| 523-541 | — | D-3721 | >12.5 | −0.2 | >12.5 | −0.10 |
| 694-712 | 577-595 | D-3722 | 0.0051033 | −0.9 | >12.5 | −0.20 |
| 1168-1186 | 1051-1069 | D-3723 | >0.195 | −0.5 | >12.5 | −0.20 |
| 891-909 | 774-792 | D-3724 | 0.00819 | −0.9 | >12.5 | −0.30 |
| 1052-1070 | 935-953 | D-3725 | >12.5 | −0.2 | >12.5 | −0.20 |
| 1116-1134 | 99-1017 | D-3726 | 0.00546 | −0.5 | >12.5 | −0.50 |
| 1228-1246 | 1111-1129 | D-3727 | 0.006855 | −0.9 | >12.5 | −0.50 |
| 952-970 | 835-853 | D-3728 | >12.5 | −0.2 | >12.5 | −0.30 |
| 975-993 | 858-876 | D-3729 | >12.5 | −0.1 | >12.5 | −0.20 |
| 850-868 | 733-751 | D-3730 | >12.5 | −0.1 | >3.13 | −0.20 |
| 288-306 | 288-306 | D-3731 | 0.0106 | −0.7 | >12.5 | −0.10 |
| 1034-1052 | 917-935 | D-3732 | 4.07 | −0.5 | >12.5 | 0.20 |
| 1180-1198 | 1063-1081 | D-3733 | 0.0311 | −0.4 | >12.5 | −0.20 |
| 897-915 | 780-798 | D-3734 | 0.005955 | −0.9 | >12.5 | −0.20 |
| 1045-1063 | 928-946 | D-3735 | >1.56 | −0.6 | >12.5 | −0.40 |
| 1225-1243 | 1108-1126 | D-3736 | >0.0488 | −0.6 | >12.5 | −0.30 |
| 1073-1091 | 956-974 | D-3737 | 0.086915 | −0.7 | >12.5 | −0.20 |
| 1260-1278 | 1143-1161 | D-3738 | 0.68126 | −0.9 | >12.5 | −0.10 |
| 796-814 | 679-697 | D-3739 | 0.024703 | −0.9 | >12.5 | −0.30 |
| 526-544 | — | D-3740 | >12.5 | −0.5 | >12.5 | −0.10 |
| 523-541 | — | D-3741 | 0.0982 | −0.8 | >12.5 | −0.10 |
| 891-909 | 774-792 | D-3742 | 0.07107 | −0.6 | >12.5 | 0.10 |
| 288-306 | 288-306 | D-3743 | 0.025805 | −0.6 | >12.5 | −0.10 |
| 897-915 | 780-798 | D-3744 | 0.03467 | −0.8 | >12.5 | 0.10 |
| 888-906 | 771-789 | D-3745 | 0.000851 | −1.0 | ND | ND |
| 692-710 | 575-593 | D-3746 | 0.00158 | −0.9 | ND | ND |
| 692-710 | 575-593 | D-3747 | 0.00289 | −0.6 | ND | ND |
| 692-710 | 575-593 | D-3748 | 0.0301 | −0.6 | ND | ND |
| 692-710 | 575-593 | D-3749 | 0.00133 | −0.9 | ND | ND |
| 692-710 | 575-593 | D-3750 | 0.00327 | −0.6 | ND | ND |
| 692-710 | 575-593 | D-3751 | 0.0043167 | −1.0 | 0.0193 | −0.70 |
| 692-710 | 575-593 | D-3752 | 0.00545 | −0.9 | 0.0507 | −0.50 |
| 692-710 | 575-593 | D-3753 | 0.00918 | −1.0 | >25.0 | 0.10 |
| 692-710 | 575-593 | D-3754 | 0.0029367 | −1.0 | >25.0 | 0.10 |
| 692-710 | 575-593 | D-3755 | 0.00034033 | −0.9 | >25.0 | 0.20 |
| 692-710 | 575-593 | D-3756 | 0.0276 | −0.5 | >25.0 | 0.10 |
| 692-710 | 575-593 | D-3757 | 0.014369 | −1.0 | >25.0 | 0.10 |
| 888-906 | 771-789 | D-3758 | 0.0029492 | −0.9 | >0.5 | −0.20 |
| 691-709 | 574-592 | D-3759 | 0.022895 | −0.8 | >0.5 | 0.10 |
| 692-710 | 575-593 | D-3760 | 0.0010037 | −0.8 | ND | ND |
| 888-906 | 771-789 | D-3761 | >0.0156 | −0.3 | ND | ND |
| 692-710 | 575-593 | D-3762 | 0.002224 | −0.7 | ND | ND |
| 692-710 | 575-593 | D-3763 | 0.001353 | −0.8 | ND | ND |
| 692-710 | 575-593 | D-3764 | >0.5 | 0.1 | ND | ND |
| 692-710 | 575-593 | D-3765 | 0.0009435 | −0.8 | ND | ND |
| 692-710 | 575-593 | D-3766 | 0.000828 | −0.7 | ND | ND |
| 692-710 | 575-593 | D-3767 | 0.0037575 | −0.9 | 0.01547 | −0.80 |
| 692-710 | 575-593 | D-3768 | 0.024725 | −0.9 | 0.0662 | −0.60 |
| 692-710 | 575-593 | D-3769 | 0.00231 | −0.4 | 0.0265 | −0.20 |
| 692-710 | 575-593 | D-3770 | >0.5 | −0.5 | ND | ND |
| 692-710 | 575-593 | D-3771 | 0.001805 | −0.8 | ND | ND |
| 692-710 | 575-593 | D-3772 | 0.001135 | −0.9 | ND | ND |
| 888-906 | 771-789 | D-3773 | 0.003285 | −1.0 | ND | ND |
| 692-710 | 575-593 | D-3774 | 0.004225 | −1.0 | 0.0415 | −0.60 |
| 692-710 | 575-593 | D-3775 | 0.003205 | −0.9 | 0.03335 | −0.50 |
| 888-906 | 771-789 | D-3776 | 0.25585 | −0.7 | >12.5 | −0.20 |
| 888-906 | 771-789 | D-3777 | 0.12353 | −1.0 | >12.5 | −0.30 |
| 888-906 | 771-789 | D-3778 | 0.00263 | −0.76 | ND | ND |
| 1185-1203 | 1068-1086 | D-3779 | >0.391 | −0.58 | ND | ND |
| 1393-1411 | 1276-1294 | D-3780 | 0.00496 | −0.82 | ND | ND |
| 395-413 | 395-413 | D-3781 | >0.195 | −0.55 | ND | ND |
| 396-414 | 396-414 | D-3782 | 0.00437 | −0.79 | ND | ND |
| 1052-1070 | 935-953 | D-3783 | >0.0977 | −0.39 | ND | ND |
| 1073-1091 | 956-974 | D-3784 | 0.00799 | −0.69 | ND | ND |
| 1074-1092 | 957-975 | D-3785 | 0.011 | −0.66 | ND | ND |

TABLE 9-continued

Efficacy of GalNAc-ASGRI siRNA conjugates in vitro

| Target site of antisense sequence within NM_ 001671.4 | Target site of antisense sequence within NM_ 1197216.2 | Duplex No. | Hep3B Trans-fected IC50 IP (μM) | Hep3B Trans-fected Max Anta-gonist Activity | hASGR1 CHO Free Uptake IC50 IP (μM) | hASGR1 CHO Free Uptake Max Anta-gonist Activity |
|---|---|---|---|---|---|---|
| 1116-1134 | 99-1017 | D-3786 | >12.5 | −0.38 | ND | ND |
| 1168-1186 | 1051-1069 | D-3787 | >12.5 | −0.30 | ND | ND |
| 1180-1198 | 1063-1081 | D-3788 | 0.00817 | −0.70 | ND | ND |
| 1425-1444 | 1308-1327 | D-3789 | 0.00365 | −0.48 | ND | ND |
| 1341-1359 | 1224-1242 | D-3790 | >6.25 | −0.74 | ND | ND |
| 1424-1443 | 1307-1326 | D-3791 | 0.00241 | −0.74 | ND | ND |
| 991-1009 | 874-892 | D-3792 | >12.5 | −0.35 | ND | ND |
| 1081-1099 | 964-982 | D-3793 | >12.5 | −0.27 | ND | ND |
| 1164-1182 | 1047-1065 | D-3794 | >12.5 | −0.46 | ND | ND |
| 563-581 | — | D-3795 | 0.00349 | −0.77 | ND | ND |
| 1225-1243 | 1108-1126 | D-3796 | >0.781 | −0.43 | ND | ND |
| 1260-1278 | 1143-1161 | D-3797 | >0.781 | −0.63 | ND | ND |
| 772-790 | 655-673 | D-3798 | >0.781 | −0.39 | ND | ND |
| 886-904 | 769-787 | D-3799 | 0.0108 | −0.76 | ND | ND |
| 891-909 | 774-792 | D-3800 | 0.0039 | −0.80 | ND | ND |
| 897-915 | 780-798 | D-3801 | 0.00575 | −0.76 | ND | ND |
| 888-906 | 771-789 | D-3802 | 0.00406 | −0.95 | >0.5 | 0.09 |
| 888-906 | 771-789 | D-3803 | 0.01116 | −0.91 | >0.5 | −0.08 |
| 888-906 | 771-789 | D-3804 | 0.00477 | −0.97 | >0.5 | −0.07 |
| 692-710 | 575-593 | D-3805 | >0.5 | 0.07 | >0.5 | −0.08 |
| 692-710 | 575-593 | D-3806 | >0.5 | 0.13 | >0.5 | 0.04 |
| 692-710 | 575-593 | D-3807 | >0.5 | 0.15 | >0.5 | −0.18 |
| 692-710 | 575-593 | D-3813 | ND | ND | 0.02753 | −0.69 |
| 692-710 | 575-593 | D-3814 | ND | ND | 0.00708 | −0.70 |
| 692-710 | 575-593 | D-3815 | ND | ND | 0.00987 | −0.49 |
| 692-710 | 575-593 | D-3816 | ND | ND | No curve fit | 0.074826181 |
| 692-710 | 575-593 | D-3817 | ND | ND | 0.02035 | −0.65 |
| 692-710 | 575-593 | D-3818 | ND | ND | 0.02340 | −0.68 |
| 692-710 | 575-593 | D-3819 | ND | ND | 0.01316 | −0.70 |
| 692-710 | 575-593 | D-3820 | ND | ND | 0.02094 | −0.75 |
| 692-710 | 575-593 | D-3821 | ND | ND | 0.03345 | −0.75 |
| 692-710 | 575-593 | D-3822 | ND | ND | 0.03030 | −0.65 |
| 692-710 | 575-593 | D-3823 | ND | ND | 0.05948 | −0.72 |
| 692-710 | 575-593 | D-3824 | ND | ND | 0.01883 | −0.43 |
| 692-710 | 575-593 | D-3825 | ND | ND | 0.01320 | −0.80 |
| 692-710 | 575-593 | D-3826 | ND | ND | 0.07031 | −0.76 |
| 692-710 | 575-593 | D-3827 | ND | ND | 0.02455 | −0.61 |
| 1186-1205 | 1069-1088 | D-3828 | ND | ND | No curve fit | 0.07 |
| 170-189 | 170-189 | D-3829 | ND | ND | No curve fit | 0.14 |
| 673-692 | 556-575 | D-3830 | ND | ND | No curve fit | 0.18 |
| 668-687 | 551-570 | D-3831 | ND | ND | No curve fit | 0.188 |
| 696-715 | 579-598 | D-3832 | ND | ND | 0.01483 | −0.78 |
| 168-187 | 168-187 | D-3833 | ND | ND | No curve fit | 0.17 |
| 1075-1094 | 958-977 | D-3834 | ND | ND | No curve fit | 0.13 |
| 1084-1103 | 967-986 | D-3835 | ND | ND | No curve fit | 0.20 |
| 157-176 | 157-176 | D-3836 | ND | ND | No curve fit | −0.20 |
| 1423-1442 | 1306-1325 | D-3837 | ND | ND | No curve fit | 0.13 |
| 970-989 | 853-872 | D-3838 | ND | ND | No curve fit | 0.16 |
| 992-1011 | 875-894 | D-3839 | ND | ND | No curve fit | 0.17 |
| 171-190 | 171-190 | D-3840 | ND | ND | No curve fit | −0.09 |
| 606-625 | 489-508 | D-3841 | ND | ND | No curve fit | 0.06 |
| 393-412 | 393-412 | D-3842 | ND | ND | No curve fit | 0.08 |
| 0632-0651 | 515-534 | D-3843 | ND | ND | No curve fit | 0.17 |
| 0990-1009 | 873-892 | D-3844 | ND | ND | 0.11508 | −0.50 |
| 1050-1069 | 933-952 | D-3845 | ND | ND | No curve fit | −0.26 |
| 807-826 | 690-709 | D-3846 | ND | ND | No curve fit | −0.05 |
| 166-185 | 166-185 | D-3847 | ND | ND | No curve fit | 0.19 |
| 1083-1102 | 966-985 | D-3848 | ND | ND | 0.01367 | −0.41 |
| 1064-1083 | 947-966 | D-3849 | ND | ND | No curve fit | 0.17 |
| 328-347 | 328-347 | D-3850 | ND | ND | No curve fit | 0.12 |
| 1079-1098 | 962-981 | D-3851 | ND | ND | No curve fit | 0.09 |
| 1123-1142 | 1006-1025 | D-3852 | ND | ND | No curve fit | −0.04 |
| 605-624 | 488-507 | D-3853 | ND | ND | No curve fit | 0.22 |
| 175-194 | 175-194 | D-3854 | ND | ND | No curve fit | 0.29 |
| 692-710 | 575-593 | D-3855 | ND | ND | No curve fit | 0.14 |
| 692-710 | 575-593 | D-3856 | ND | ND | No curve fit | 0.11 |
| 692-710 | 575-593 | D-3857 | 0.00532 | −0.61 | >0.5 | −0.44 |

Several of the GalNAc-ASGR1 siRNA conjugates were evaluated further for efficacy in knocking down ASGR1 mRNA levels in hepatocytes. Following the manufacturers protocol, human primary hepatocyte cells (Xenotech/Sekisui donor lot #HC3-38) were thawed in Opti Thaw media (Xenotech cat #K8000). Cells were centrifuged and post media aspiration, resuspended in OptiPlate hepatocyte media (Xenotech cat #K8200) and plated into 96 well collagen coated plates (Greiner cat #655950). Following a 2-4 hour incubation period, media was removed and replaced with OptiCulture hepatocyte media (Xenotech cat #K8300). 2-4 hours following the addition of OptiCulture media, GalNAc-conjugated siRNAs were delivered to cells via free uptake (no transfection reagent). Cells were incubated 24-72 hours at 37° C. and 5% $CO_2$. Cells were then lysed with Qiagen RLT buffer (79216)+1% 2-mercaptoethanol (Sigma, M-3148), and the lysates were stored at −20° C. RNA was purified using a Qiagen QIACube HT instrument (9001793) and a Qiagen RNeasy 96 QIACube HT Kit (74171) according to manufacturer's instructions. Samples were analyzed using a QIAxpert system (9002340).

cDNA was synthesized from RNA samples using the Applied Biosystems High Capacity cDNA Reverse Transcription kit (4368813), reactions were assembled according to manufacturer's instructions, input RNA concentration varied by sample. Reverse transcription was carried out on a BioRad tetrad thermal cycler (model #PTC-0240G) under the following conditions: 25° C. 10 minutes, 37° C. 120 minutes, 85° C. 5 minutes followed by (an optional) 4° C. infinite hold. Droplet digital PCR (ddPCR) was performed using BioRad's QX200 AutoDG droplet digital PCR system according to manufacturer's instructions. Reactions were assembled into an Eppendorf clear 96 well PCR plate (951020303) using BioRad ddPCR Supermix for Probes (1863010), fluorescently labeled qPCR assays for ASGR1 (IDT Hs.PT.56a.24725395, ordered with primer to probe ratio 3.6:1, 9 nanomoles each forward and reverse primer (sequences listed below), 2.5 nanomoles 6-FAM/ZEN/IBFQ labeled probe (sequence listed below)) and GUSB (IDT Hs.PT.58v.27737538, ordered with primer to probe ratio 3.6:1, 9 nanomoles each forward and reverse primer (sequences listed below), 2.5 nanomoles HEX/ZEN/IBFQ labeled probe (sequence listed below)) and RNase free water (Ambion, AM9937). Final primer/probe concentration was 900 nM/250 nM respectively, input cDNA concentration varied among wells.

Droplets were formed using a BioRad Auto DG droplet generator (1864101) set up with manufacturer recommended consumables (BioRad DG32 cartridges 1864108, BioRad tips 1864121, Eppendorf blue 96well PCR plate 951020362, BioRad droplet generation oil for probes 1864110 and a BioRad droplet plate assembly). Droplets were amplified on a BioRad $C_{1000}$ touch thermal cycler (1851197) using the following conditions: enzyme activation 95° C. 10 minutes, denaturation 94° C. 30 seconds followed by annealing/extension 60° C. for one minute, 40 cycles using a 2° C./second ramp rate, enzyme deactivation 98° C. 10 minutes followed by (an optional) 4° C. infinite hold. Samples were then read on a BioRad QX200 Droplet Reader measuring FAM/HEX signal that correlated to ASGR1 or GUSB concentration, respectively. Data was analyzed using BioRad's QuantaSoft software package. Samples were gated by channel (fluorescent label) to determine the concentration per sample. Each sample was then expressed as the ratio of the concentration of the gene of interest (ASGR1)/concentration of the housekeeping gene (GUSB) to control for differences in sample loading. Data was then imported into Genedata Screener, where each test siRNA was normalized to the median of the neutral control wells (buffer only) and was expressed as the POC (percent of control). IC50 and max activity are reported in Table 10 below.

ddPCR Assay Sequences

ASGR1:

Primer 1: CAGGCTGGAGTGATCTTCA (SEQ ID NO: 4688)

Primer 2: TTCAGCAACTTCACAGCGA (SEQ ID NO: 4689)

Probe: 56-FAM/TCTTTCTTC (SEQ ID NO: 4690)/ZEN/CCACATTGCCTCCCTG (SEQ ID NO: 4691)/3IABkFQ/

GUSB:

Primer 1: GTTTTTGATCCAGACCCAGATG (SEQ ID NO: 4692)

Primer 2: GCCCATTATTCAGAGCGAGTA (SEQ ID NO: 4693)

Probe: 5HEX/TGCAGGGTT (SEQ ID NO: 4694)/ZEN/TCACCAGGATCCAC (SEQ ID NO: 4695)/3IABkFQ/

TABLE 10

ASGR1 mRNA in vitro knockdown by select GalNAc-ASGRI conjugates

| Duplex No. | Primary Human Hepatocyte ddPCR IC50 (μM) | Primary Human Hepatocyte ddPCR Max Activity |
|---|---|---|
| D-3779 | 0.0302 | −0.46 |
| D-3780 | 0.0040 | −0.80 |
| D-3781 | 0.0158 | −0.40 |
| D-3782 | 0.0084 | −0.79 |
| D-3783 | — | −0.19 |
| D-3784 | 0.0281 | −0.42 |
| D-3785 | 0.0249 | −0.40 |
| D-3786 | 0.0267 | −0.32 |
| D-3787 | — | 0.03 |
| D-3788 | 0.0127 | −0.49 |
| D-3789 | — | −0.26 |
| D-3790 | 0.0046 | −0.34 |
| D-3791 | 0.0041 | −0.81 |
| D-3792 | — | −0.03 |
| D-3793 | — | −0.09 |
| D-3794 | — | −0.05 |
| D-3795 | 0.0022 | −0.66 |
| D-3796 | — | 0.17 |
| D-3797 | 0.0875 | −0.45 |
| D-3798 | 0.0114 | −0.38 |
| D-3799 | 0.0135 | −0.36 |
| D-3800 | 0.0094 | −0.73 |
| D-3801 | 0.0159 | −0.57 |

The majority of the tested GalNAc-siRNA conjugates reduced ASGR1 mRNA levels in primary human hepatocytes indicating that the conjugates were effectively delivered to the cells and the siRNAs were active. Compounds D-3780, D-3782, D-3791, D-3795, and D-3800 were the most potent and had the highest maximum inhibitory activity of the conjugates evaluated in this assay. These compounds also exhibited potent inhibiton of ASGR1 protein expression when transfected into Hep3B cells. See Hep3B transfection assay data in Table 9.

Example 9. In Vivo Efficacy of GalNAc-ASGR1 siRNA Conjugates

To assess whether the GalNAc-ASGR1 siRNA conjugates could effectively silence ASGR1 expression in vivo, conjugates exhibiting the best in vitro inhibition as measured by ddPCR (Table 10) were administered to ASGR1 knockout mice expressing the human ASGR1 gene. 10-12 week old ASGR1 knockout mice (The Jackson Laboratory) were i.v. injected with an adeno-associated virus (AAV) encoding the human ASGR1 gene (AAV-hASGR1) at a dose of $1\times10^{12}$ genome copies (GC) per animal. Two weeks following AAV-hASGR1 injection, mice received a s.c. injection of buffer or the indicated GalNAc-siRNA conjugate (compounds D-3752, D-3779, D-3780, D-3782, D-3784, D-3785, D-3788, D-3791, D-3795, D-3797, D-3799, D-3800, and D-3801) at 5 mg/kg body weight in 0.25 ml buffer (n=6 each group). At day 8 following compound administration, three animals in each treatment group were euthanized and harvested for further analysis. The remaining three animals in each treatment group were harvestred at day 15 following compound administration. Serum and livers were collected from all animals. Total RNA isolated from the livers of the animals was processed for qPCR analysis to assess human ASGR1 mRNA levels. Serum levels of alkaline phosphatase (ALP) were measured by a clinical analyzer (AU400 Chemistry Analyzer, Olympus). Elevated levels of ALP in the serum has been reported to correlate with reduced serum levels of non-HDL cholesterol and reduced risk of coronary artery disease (Nioi et al., New England Journal of Medicine, Vol. 374 (22): 2131-2141, 2016), and thus serves as useful biomarker.

Figure 6A:
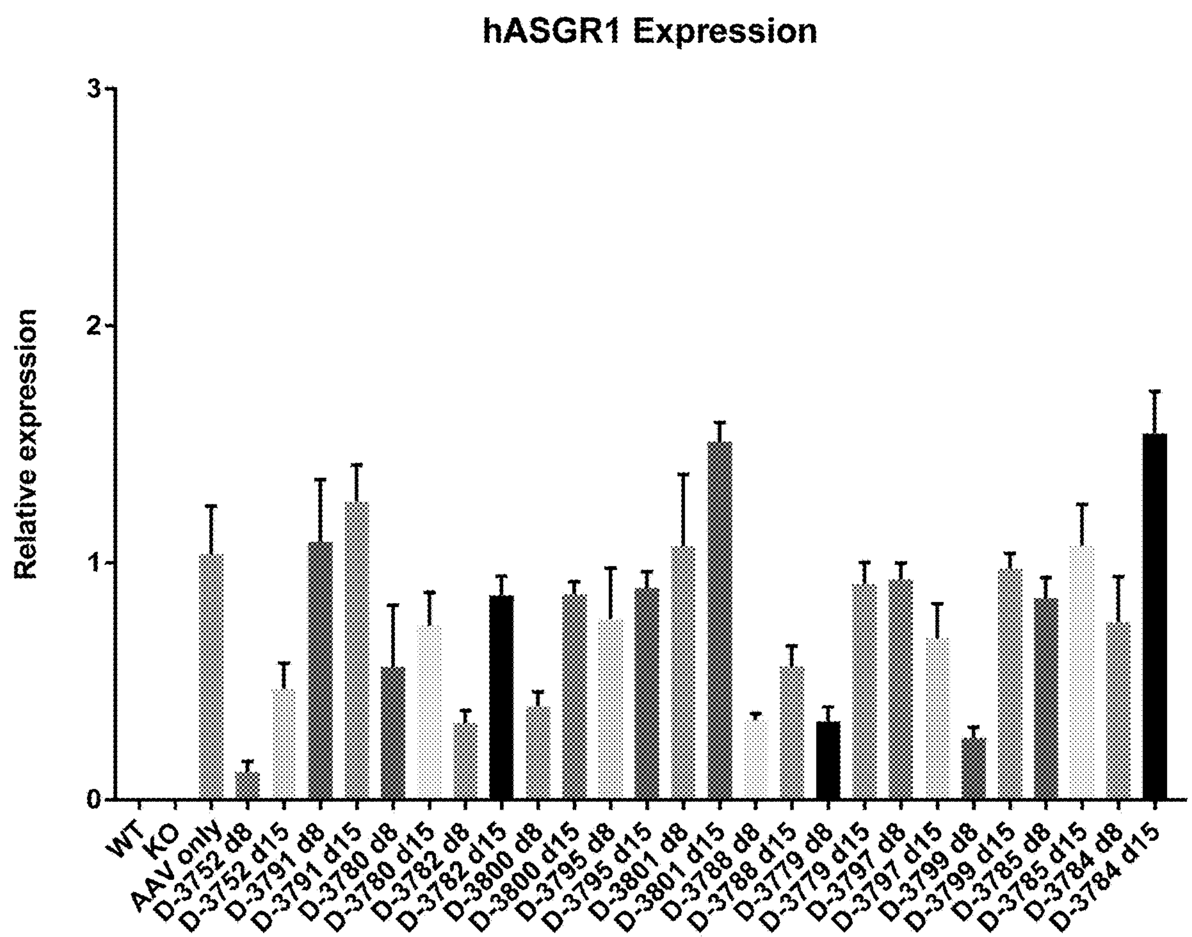
FIG. 6A is a bar graph of human ASGR1 expression levels in livers of ASGR1 knockout mice injected with an AAV encoding human ASGR1 and treated with 5 mg/kg subcutaneous injections of the indicated GalNAc-ASGR1 siRNA conjugates. Human ASGR1 expression was measured by qPCR and is reported as expression levels relative to the AAV only control animals, which were ASGR1 knockout animals injected with the AAV encoding human ASGR1, but were otherwise untreated. Expression levels are shown at day 8 (d8) and day 15 (d15) after GalNAc-siRNA conjugate administration. Wild-type (WT) mice and ASGR1 knockout (KO) animals were included as controls.
Figure 6B:
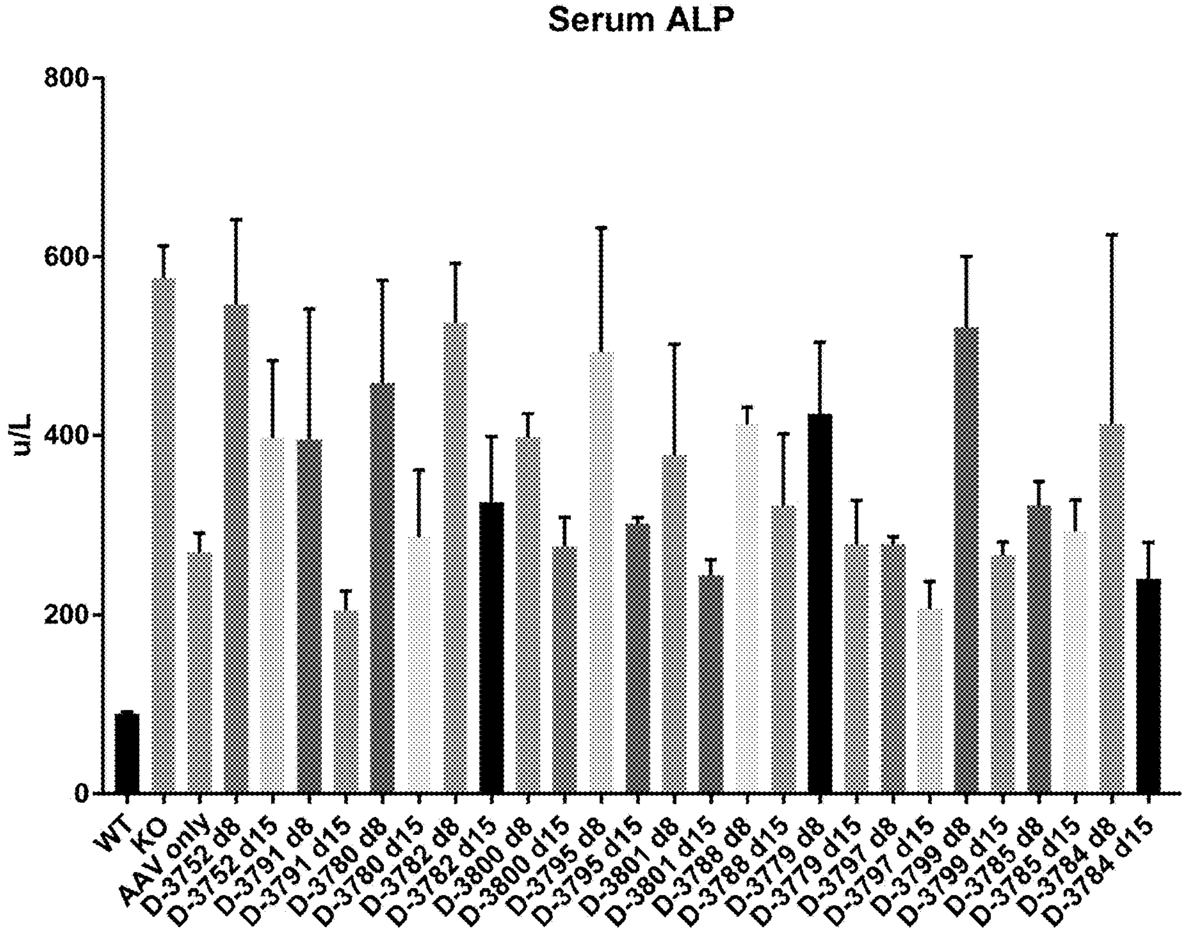
FIG. 6B is a bar graph of serum levels of alkaline phosphatase (ALP) from the animals described in FIG. 6A. Serum was obtained at day 8 (d8) and day 15 (d15) following administration of the indicated GalNAc-siRNA conjugates.

As shown in FIG. 6A, several of the GalNAc-siRNA conjugates reduced human ASGR1 mRNA levels 8 days following administration. Compounds D-3752, D-3779, D-3782, D-3788, D-3799, and D-3800 were particularly effective. Suppression of hASGR1 mRNA levels 15 days following compound administration was observed for some of the compounds. Compounds D-3752 and D-3788 were especially effective at this time point. FIG. 6B shows serum ALP levels at the same time points. Generally, elevation of serum ALP levels correlated with knockdown of hASGR1 mRNA. Some of the compounds (e.g. D-3752, D-3782) produced elevation of serum ALP to levels similar to those observed in ASGR1 knockout animals, which represent maximum inhibition of ASGR1 expression. The results of the in vivo experiments demonstrate that the GalNAc-ASGR1 siRNA conjugates, when administered subcutaneously, effectively suppress ASGR1 gene expression in the liver and modulate serum ALP, a biomarker of efficacy in treating coronary artery disease.

Example 10. ASGR1 Antibody as an Alternative Delivery Mechanism for siRNA Molecules The purpose of the experiments described in this example was to determine whether a monoclonal antibody against ASGR1 could be used to deliver ASGR1 siRNA molecules to the liver. An anti-ASGR1 monoclonal antibody with an E272C mutation in its heavy chain according to the EU numbering scheme (anti-ASGR1 cys mAb, 200 mg) was incubated with 50 mL solution of 2.5 mM cystamine and 2.5 mM cysteamine in 40 mM HEPES buffer, pH 7.5-8.5 for 15-20 h at RT. The amino acid sequences of the heavy chain and light chain of the anti-ASGR1 antibody are provided below as SEQ ID NOs: 4696 and 4697, respectively. The reaction mixture was filtered using a 0.22 μm filter, and diluted to 250 mL with 100 mM sodium acetate buffer pH 5. Cation exchange chromatography was performed to purify the bis-cysteamine-capped anti-ASGR1 cys mAb from the reaction mixture. First, 250 mL of reaction mixture diluted in 100 mM sodium acetate buffer pH 5 was loaded onto 25 mL SP HP column (GE Healthcare Life Sciences) at 5 mL/min. The column was washed with 2 column volumes (CV) of 100 mM sodium acetate pH 5, followed by a 0-20% gradient of 100 mM sodium acetate with 1.2 M sodium chloride (NaCl) pH 5 over 10 CV. The main peak containing bis-cysteamine-capped anti-ASGR1 cys mAb was collected and buffer exchanged into 10 mM sodium acetate with 9% sucrose pH 5.2 via dialysis.

Anti-ASGR1 Cys mAb Heavy Chain

```
                                          (SEQ ID NO: 4696)
QVQLVESGGGVVQPGRSLRLSCAASGFTFSSYGMHWVRQAPGKGLEWVAV
IWYDGSNKYYADSVKGRFTISRDNSKNTLYLQMNSLRAEDTAVYYCARDS
SPYGMDVWGQGTTVTVSSASTKGPSVFPLAPSSKSTSGGTAALGCLVKDY
FPEPVTVSWNSGALTSGVHTFPAVLQSSGLYSLSSVVTVPSSSLGTQTYI
CNVNHKPSNTKVDKKVEPKSCDKTHTCPPCPAPELLGGPSVFLFPPKPKD
TLMISRTPEVTCVVVDVSHEDPCVKFNWYVDGVEVHNAKTKPCEEQYGST
YRCVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGK
```

Anti-ASGR1 Cys mAb Light Chain

```
                                          (SEQ ID NO: 4697)
DIQMTQSPSSVSASVGDRVTITCRASQGISSWLAWYQQKPGKAPKLLIYG
ASSLQSGVPSRFSASGSGTDFTLTISSLQPEDFATYYCQQSDSFPRTFGQ
GTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC
```

Figure 7A:
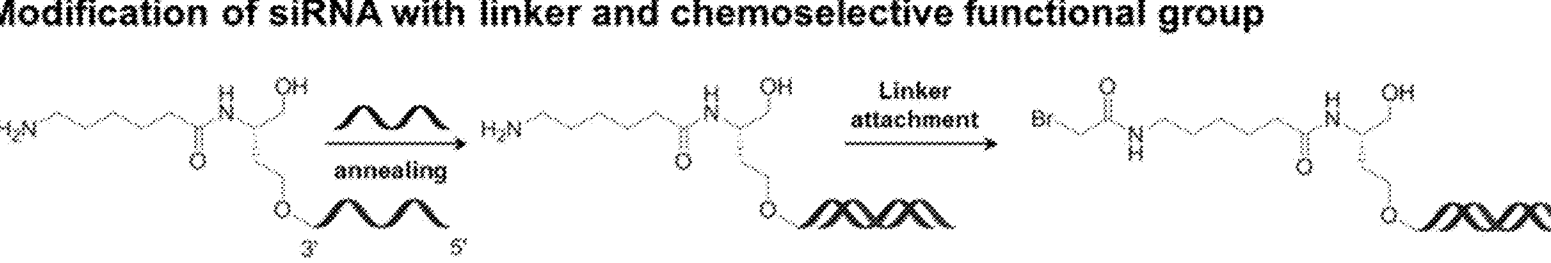
FIG. 7A is a schematic illustrating the reaction to add a bromoacetyl linker to the 3' end of the sense strand of a siRNA duplex.

A siRNA duplex containing a sense strand having a sequence (5' to 3') of GfsusGfgGfaAfgAfAfAfgAfuGfaAfgUfuUf (SEQ ID NO: 4698) and an antisense strand having a sequence (5' to 3') of asCfsuUfcAfuCfuuuCfuUfcCfcAfcsUfsu (SEQ ID NO: 4699) was used to generate the mAb-siRNA conjugate. The notations in the sense and antisense sequences are the same as those used for the nucleotide sequences in Tables 6 and 8 described above. The siRNA duplex had a 19 base pair duplex region with a 2 nucleotide overhang at the 3' end of the sense and antisense strands. The sense strand of the siRNA duplex had a homoserine-aminohexanoic acid (hSer-Ahx) modification at its 3' end. The siRNA duplex was formed in 100 mM potassium acetate, 30 mM HEPES-KOH, pH 7.4 upon heating to 90° C. for 5 min and cooling to RT over 30 min. The 3' hSer-Ahx siRNA duplex was further functionalized with a bromoacetyl group using succinimidyl bromoacetate (SBA) (FIG. 7A). The 3' hSer-Ahx siRNA duplex in 100 mM potassium acetate, 30 mM HEPES-KOH, pH 7.4 was incubated with 10-20 equivalents of SBA at RT for 1 h. Then, an additional 10-20 equivalents of SBA were added, and the reaction mixture was incubated at RT for another hour. The reaction was monitored using LC-TOF. Excess SBA was removed from the 3'-bromoacetyl-siRNA by buffer exchanging with 50 mM sodium phosphate, 2 mM ethylenediaminetetraacetic acid (EDTA), pH 7.5 using Amicon-15 3k spin concentrators.

Figure 7B:
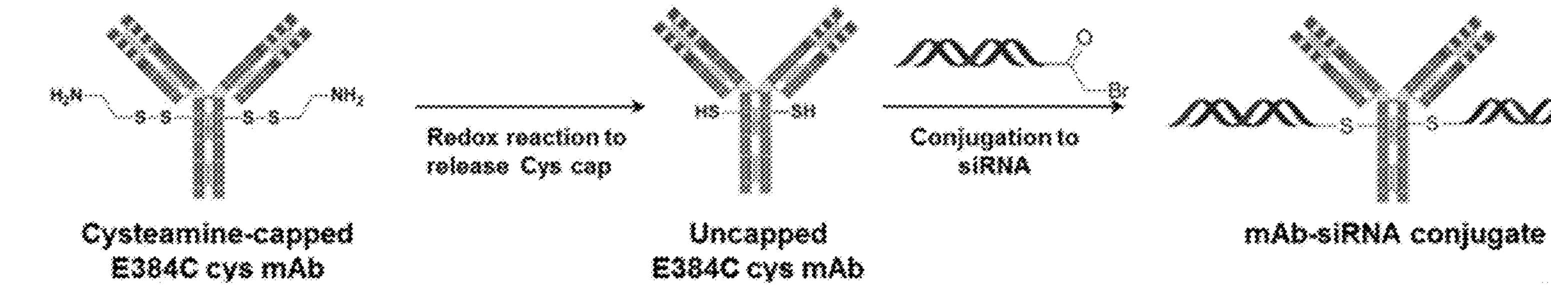
FIG. 7B is a schematic depicting the conjugation reaction to attach a siRNA duplex to an anti-ASGR1 antibody.

Bis-cysteamine-capped anti-ASGR1 cys mAb (~5 mg/mL in 10 mM sodium acetate with 9% sucrose) was partially reduced using 3-4 equivalents of tris(2-carboxyethyl) phosphine (TCEP) or triphenylphosphine-3,3',3"-trisulfonic acid trisodium salt (TPPTS) at RT for 60-90 min (FIG. 7B). The reaction was monitored using analytical cation exchange chromatography. TCEP or TPPTS was removed, and partially reduced cys mAb was buffer exchanged into 50 mM sodium phosphate buffer pH 7.5 containing 2 mM EDTA. To the partially reduced cys mAb was added 6-10 equivalents of dehydroascorbic acid (DHAA), and oxidation was carried out at RT until only trace amount of reduced mAb species were observed (30-180 min). Without removing DHAA, 6 equivalents of bromoacetyl-siRNA duplex were added to the reaction mixture, and the alkylation was carried out at RT for 15-48 h (FIG. 7B). Excess siRNA duplex and small molecule reagents were removed by size exclusion chromatography (SEC) with isocratic flow of 0.17 M potassium phosphate, 0.21 M potassium chloride, 10% (v/v) isopropanol, pH 7. The anti-ASGR1 mAb-siRNA conjugates with RNA-to-antibody ratio (RAR) of 1 and 2 were separated using anion exchange chromatography. The SEC pool was diluted in 20 mM Tris-HCl pH 7, 100 mM NaCl and loaded onto Q HP column (GE Healthcare Life Sciences). The column was washed with 5 CV of 20 mM Tris-HCl pH 7, 100 mM NaCl, followed by a gradient elution with 20 mM Tris-HCl pH 7 containing 0.4 to 1 M NaCl over 20 CV. The purified RAR1 (compound 3549) and RAR2 (compound 3550) products were buffer exchanged into Dulbecco's phosphate-buffered saline (DPBS) using spin concentration.

Figure 8:
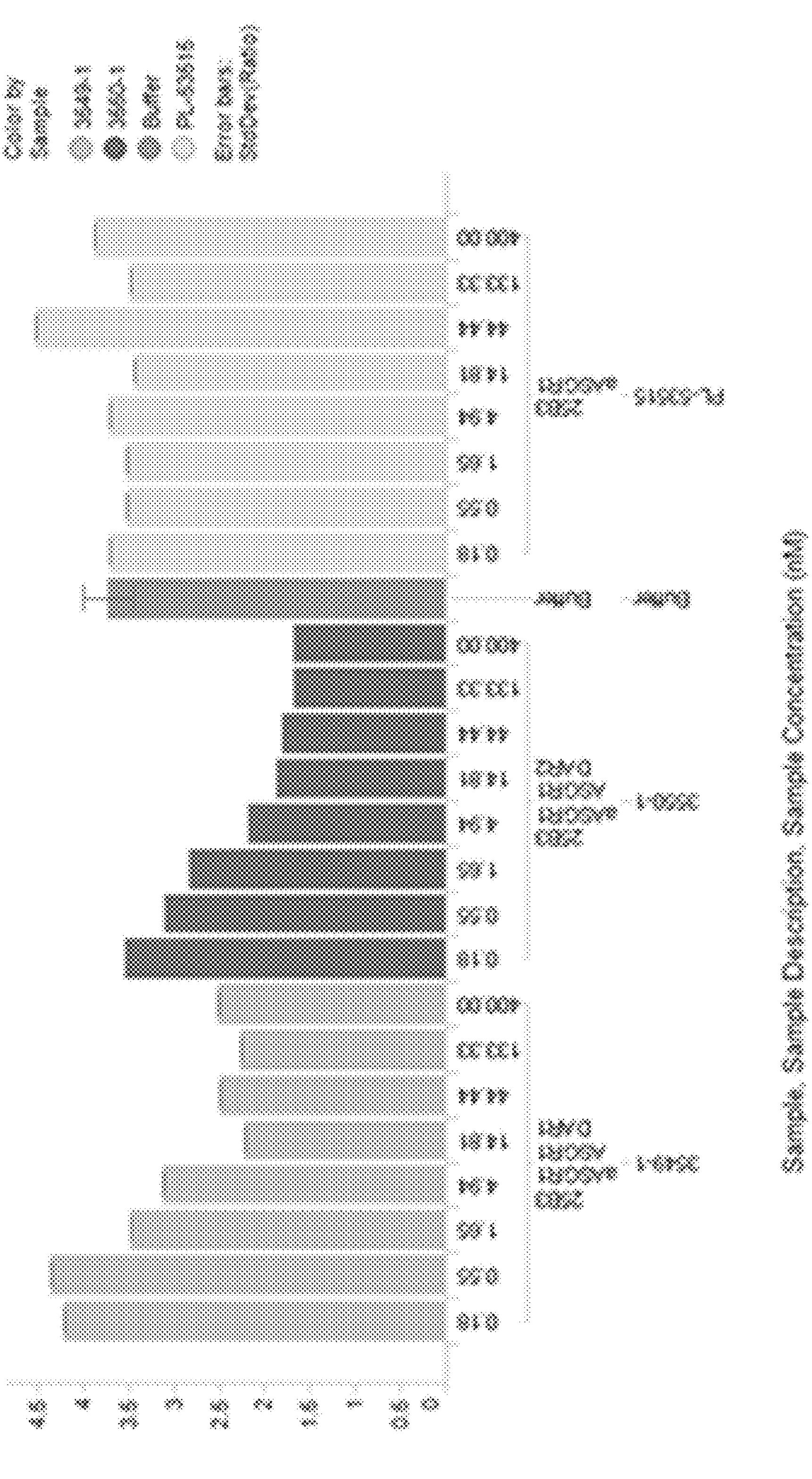
FIG. 8 is a bar graph showing a dose-dependent knockdown of ASGR1 mRNA in human primary hepatocytes observed with the 3549 (RNA-Ab ratio of 1) and 3550 (RNA-Ab ratio of 2) anti-ASGR1 mAb-siRNA conjugates. The unconjugated anti-ASGR1 cys mAb (PL-53515) was used as a control.

The mAb-siRNA conjugates were evaluated for activity in a free uptake assay to determine whether the antibody could effectively deliver the siRNA to human primary hepatocytes to inhibit ASGR1 expression. Various concentrations (0.18 nM to 400 nM) of the anti-ASGR1 mAb conjugated to 1 or 2 ASGR1 siRNA molecules (compounds 3549 and 3550, respectively) were incubated with human primary hepatocytes for four days. RNA was isolated from the cells and processed for droplet digital PCR analysis to assess ASGR1 mRNA levels as described in Example 8. The results of the in vitro assay are shown in FIG. 8. The anti-ASGR1 mAb conjugated to 1 or 2 ASGR1 siRNA molecules demonstrated 40-60% knockdown of ASGR1 mRNA. The unconjugated anti-ASGR1 cys mAb (PL-53515) was used as a control.

Next, the anti-ASGR1 mAb-siRNA conjugates were tested for in vivo efficacy. Nine-week old C57Bl/6 wild-type mice were injected subcutaneously or intravenously with compound 3550 (30 mg/kg or 60 mg/kg) or a GalNAc-conjugated siRNA control. The GalNAc-conjugated siRNA control had a sense strand having a sequence of SEQ ID NO: 4698 and an antisense strand having a sequence of SEQ ID NO: 4699 and was conjugated to a triantennary GalNAc moiety at the 3' end of the sense strand. Serum and livers were collected from the animals at days 2, 4, 8, and 15 following compound administration. Total RNA isolated from the livers of the animals was processed for qPCR analysis to assess ASGR1 mRNA levels. ASGR1 protein expression in the liver was measured by ELISA. Serum levels of alkaline phosphatase (ALP) were measured by a clinical analyzer (AU400 Chemistry Analyzer, Olympus).

Figure 9A:
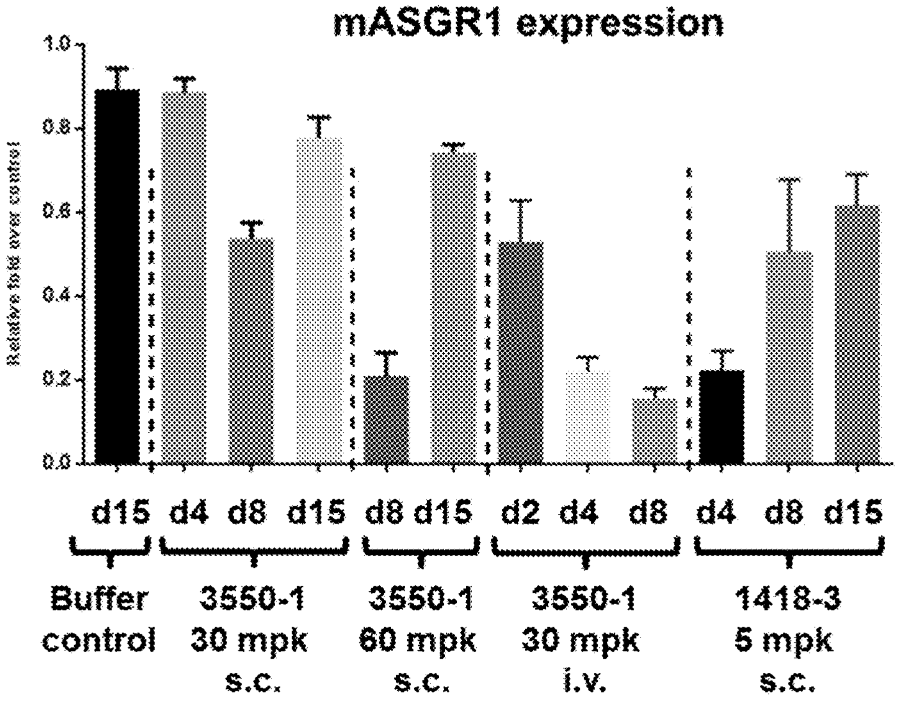
FIG. 9A is a bar graph showing the ASGR1 mRNA level in livers from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.
Figure 9B:
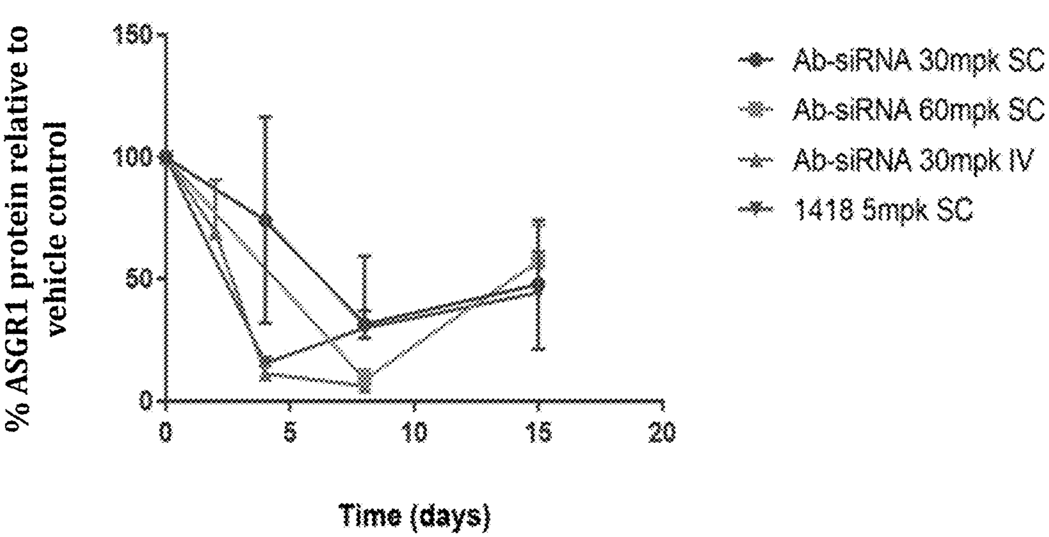
FIG. 9B is a line graph depicting ASGR1 protein expression in livers from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.
Figure 10:
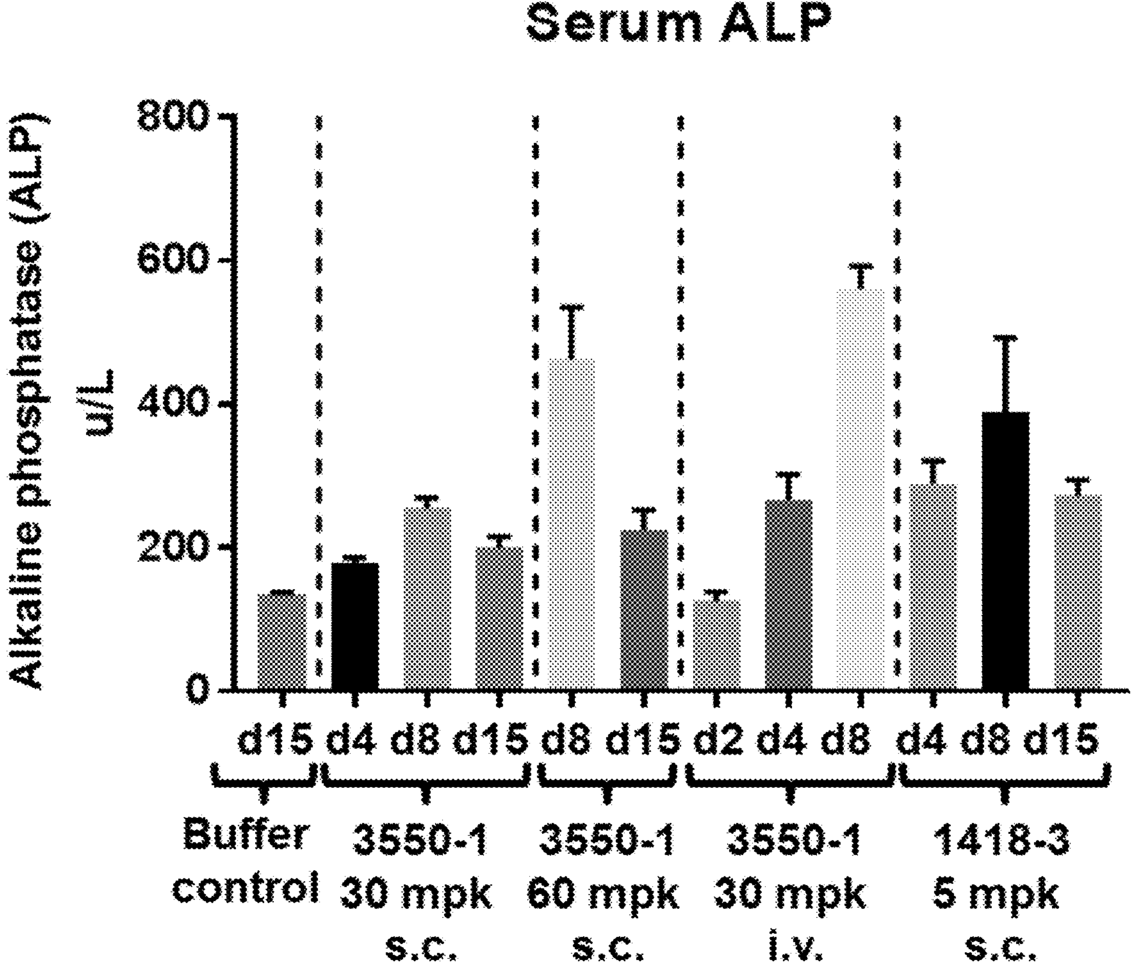
FIG. 10 is a bar graph showing serum alkaline phosphatase (ALP) from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.

The mAb-siRNA conjugate 3550 effectively delivered siRNA to its mRNA target in vivo. The highest knockdown level (~80%) resulted from 30 mpk i.v. administration of 3550 in wild-type mice measured on day 8 (FIG. 9A). The ASGR1 protein expression in liver was also measured, and >80% reduction in ASGR1 protein was achieved in the 30 mpk i.v. group, consistent with the level of mRNA knockdown (FIG. 9B). Nadir of protein knockdown was day 8 for the anti-ASGR1 mAb-siRNA conjugate, dosed either i.v. or s.c., and day 4 for the GalNAc-siRNA conjugate. The mAb-siRNA conjugate 3550 resulted in 2-4 fold increase in ALP on day 8, corresponding to decreased ASGR1 mRNA level and protein expression (FIG. 10). The anti-ASGR1 antibody alone did not induce any increase in ALP even at 100 mg/kg (data not shown).

Taken together, the results of these experiments demonstrate that siRNA duplexes can be effectively delivered to the liver using an anti-ASGR1 antibody in lieu of a GalNAc moiety. The mAb-siRNA conjugates exhibited comparable efficacy to a GalNAc-siRNA conjugate in terms of inhibition of liver ASGR1 expression and elevation of serum ALP levels, a biomarker of target inhibition.

All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the following claims.

SEQUENCE LISTING (4699 sequences)

SEQ ID NO: 1 - DNA, 1519 bp, Homo sapiens
  source 1..1519: mol_type = other DNA
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaaaaaaaaaaaaaaaaa

SEQ ID NO: 2 - DNA, 1402 bp, Homo sapiens
  source 1..1402: mol_type = other DNA
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaaaaaaaaaaaaaaaaa

SEQ ID NO: 3 - protein, 214 aa, synthetic construct
DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 448 aa, synthetic construct
QVQLVESGGGVVQPGRSLRLSCAASGFTFSSFGMHWVRQAPGKGLEWVAIIWHDGSNKYYADSVKGRFTISRDNSKNTLYLQMSSLRAEDTAVYYCARDLSMGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - RNA, 21 nt, synthetic construct
  source 1..21: mol_type = other RNA
tgtccagcaccacataggctt

SEQ ID NO: 6 - RNA, 21 nt, synthetic construct
  source 1..21: mol_type = other RNA
gtccagcaccacataggcctt

SEQ ID NO: 7 - RNA, 21 nt, synthetic construct
  source 1..21: mol_type = other RNA
cacccccacactcccctaatt

SEQ ID NO: 8 - RNA, 21 nt, synthetic construct
  source 1..21: mol_type = other RNA
tccagcaccacataggccctt

SEQ ID NO: 9 - RNA, 21 nt, synthetic construct
  source 1..21: mol_type = other RNA
ccagcaccacataggcccttt

SEQ ID NO: 10 - RNA, 21 nt, synthetic construct
  source 1..21: mol_type = other RNA
cagcaccacataggccctgtt

SEQ ID NO: 11 - RNA, 21 nt, synthetic construct
  source 1..21: mol_type = other RNA
agcaccacataggccctgttt

SEQ ID NO: 12 - RNA, 21 nt, synthetic construct
  source 1..21: mol_type = other RNA
gcaccacataggccctgtgtt

SEQ ID NO: 13 - RNA, 21 nt, synthetic construct
  source 1..21: mol_type = other RNA
caccacataggccctgtgatt

SEQ ID NO: 14 - RNA, 21 nt, synthetic construct
  source 1..21: mol_type = other RNA
accacataggccctgtgaatt

SEQ ID NO: 15 - RNA, 21 nt, synthetic construct
  source 1..21: mol_type = other RNA
ccacataggccctgtgaactt

SEQ ID NO: 16 - RNA, 21 nt, synthetic construct
  source 1..21: mol_type = other RNA
cacataggccctgtgaacatt

SEQ ID NO: 17 - RNA, 21 nt, synthetic construct
  source 1..21: mol_type = other RNA
acataggccctgtgaacactt

SEQ ID NO: 18 - RNA, 21 nt, synthetic construct
  source 1..21: mol_type = other RNA
acccccacactcccctaagtt

SEQ ID NO: 19 - RNA, 21 nt, synthetic construct
  source 1..21: mol_type = other RNA
cataggccctgtgaacacctt

SEQ ID NO: 20 - RNA, 21 nt, synthetic construct
  source 1..21: mol_type = other RNA
ataggccctgtgaacaccttt

SEQ ID NO: 21 - RNA, 21 nt, synthetic construct
  source 1..21: mol_type = other RNA
taggccctgtgaacacctgtt

SEQ ID NO: 22 - RNA, 21 nt, synthetic construct
  source 1..21: mol_type = other RNA
aggccctgtgaacacctggtt

SEQ ID NO: 23 - RNA, 21 nt, synthetic construct
  source 1..21: mol_type = other RNA
ggccctgtgaacacctggatt

SEQ ID NO: 24 - RNA, 21 nt, synthetic construct
  source 1..21: mol_type = other RNA
gccctgtgaacacctggattt

SEQ ID NO: 25 - RNA, 21 nt, synthetic construct
  source 1..21: mol_type = other RNA
ccctgtgaacacctggatgtt

SEQ ID NO: 26 - RNA, 21 nt, synthetic construct
  source 1..21: mol_type = other RNA
cctgtgaacacctggatggtt

SEQ ID NO: 27 - RNA, 21 nt, synthetic construct
  source 1..21: mol_type = other RNA
ctgtgaacacctggatgggtt

SEQ ID NO: 28 - RNA, 21 nt, synthetic construct
  source 1..21: mol_type = other RNA
tgtgaacacctggatgggctt

SEQ ID NO: 29 - RNA, 21 nt, synthetic construct
  source 1..21: mol_type = other RNA
cccccacactcccctaagttt

SEQ ID NO: 30 - RNA, 21 nt, synthetic construct
  source 1..21: mol_type = other RNA
gtgaacacctggatgggcctt

SEQ ID NO: 31 - RNA, 21 nt, synthetic construct
  source 1..21: mol_type = other RNA
tgaacacctggatgggccttt

SEQ ID NO: 32 - RNA, 21 nt, synthetic construct
  source 1..21: mol_type = other RNA
gaacacctggatgggcctctt

SEQ ID NO: 33 - RNA, 21 nt, synthetic construct
  source 1..21: mol_type = other RNA
aacacctggatgggcctcctt

SEQ ID NO: 34 - RNA, 21 nt, synthetic construct
  source 1..21: mol_type = other RNA
acacctggatgggcctccatt

SEQ ID NO: 35 - RNA, 21 nt, synthetic construct
  source 1..21: mol_type = other RNA
cacctggatgggcctccactt

SEQ ID NO: 36 - RNA, 21 nt, synthetic construct
  source 1..21: mol_type = other RNA
tgcacggaagagtgaggtgtt

SEQ ID NO: 37 - RNA, 21 nt, synthetic construct
  source 1..21: mol_type = other RNA
acctggatgggcctccacgtt

SEQ ID NO: 38 - RNA, 21 nt, synthetic construct
  source 1..21: mol_type = other RNA
cctggatgggcctccacgatt

SEQ ID NO: 39 - RNA, 21 nt, synthetic construct
  source 1..21: mol_type = other RNA
ctggatgggcctccacgactt

SEQ ID NO: 40 - RNA, 21 nt, synthetic construct
  source 1..21: mol_type = other RNA
tggatgggcctccacgacctt

SEQ ID NO: 41 - RNA, 21 nt, synthetic construct
  source 1..21: mol_type = other RNA
ccccacactcccctaagtttt

SEQ ID NO: 42 - RNA, 21 nt, synthetic construct
  source 1..21: mol_type = other RNA
ggatgggcctccacgaccatt

SEQ ID NO: 43 - RNA, 21 nt, synthetic construct
  source 1..21: mol_type = other RNA
gatgggcctccacgaccaatt

SEQ ID NO: 44 - RNA, 21 nt, synthetic construct
  source 1..21: mol_type = other RNA
atgggcctccacgaccaaatt

SEQ ID NO: 45 - RNA, 21 nt, synthetic construct
  source 1..21: mol_type = other RNA
tgggcctccacgaccaaaatt

SEQ ID NO: 46 - RNA, 21 nt, synthetic construct
  source 1..21: mol_type = other RNA
gggcctccacgaccaaaactt

SEQ ID NO: 47 - RNA, 21 nt, synthetic construct
  source 1..21: mol_type = other RNA
ggcctccacgaccaaaacgtt

SEQ ID NO: 48 - RNA, 21 nt, synthetic construct
  source 1..21: mol_type = other RNA
gcctccacgaccaaaacggtt

SEQ ID NO: 49 - RNA, 21 nt, synthetic construct
  source 1..21: mol_type = other RNA
cctccacgaccaaaacgggtt

SEQ ID NO: 50 - RNA, 21 nt, synthetic construct
  source 1..21: mol_type = other RNA
ctccacgaccaaaacgggctt

SEQ ID NO: 51 - RNA, 21 nt, synthetic construct
  source 1..21: mol_type = other RNA
tccacgaccaaaacgggcctt

SEQ ID NO: 52 - RNA, 21 nt, synthetic construct
  source 1..21: mol_type = other RNA
cccacactcccctaagttctt

SEQ ID NO: 53 - RNA, 21 nt, synthetic construct
  source 1..21: mol_type = other RNA
ccacgaccaaaacgggccctt

SEQ ID NO: 54 - RNA, 21 nt, synthetic construct
  source 1..21: mol_type = other RNA
cacgaccaaaacgggcccttt

SEQ ID NO: 55 - RNA, 21 nt, synthetic construct
  source 1..21: mol_type = other RNA
acgaccaaaacgggccctgtt

SEQ ID NO: 56 - RNA, 21 nt, synthetic construct
  source 1..21: mol_type = other RNA
cgaccaaaacgggccctggtt

SEQ ID NO: 57 - RNA, 21 nt, synthetic construct
  source 1..21: mol_type = other RNA
gaccaaaacgggccctggatt

SEQ ID NO: 58 - RNA, 21 nt, synthetic construct
  source 1..21: mol_type = other RNA
accaaaacgggccctggaatt

SEQ ID NO: 59 - RNA, 21 nt, synthetic construct
  source 1..21: mol_type = other RNA
ccaaaacgggccctggaagtt

SEQ ID NO: 60 - RNA, 21 nt, synthetic construct
  source 1..21: mol_type = other RNA
caaaacgggccctggaagttt

SEQ ID NO: 61 - RNA, 21 nt, synthetic construct
  source 1..21: mol_type = other RNA
aaaacgggccctggaagtgtt

SEQ ID NO: 62 - RNA, 21 nt, synthetic construct
  source 1..21: mol_type = other RNA
aaacgggccctggaagtggtt

SEQ ID NO: 63 - RNA, 21 nt, synthetic construct
  source 1..21: mol_type = other RNA
ccacactcccctaagttcctt

SEQ ID NO: 64 - RNA, 21 nt, synthetic construct
  source 1..21: mol_type = other RNA
aacgggccctggaagtgggtt

SEQ ID NO: 65 - RNA, 21 nt, synthetic construct
  source 1..21: mol_type = other RNA
acgggccctggaagtgggttt

SEQ ID NO: 66 - RNA, 21 nt, synthetic construct
  source 1..21: mol_type = other RNA
cgggccctggaagtgggtgtt

SEQ ID NO: 67 - RNA, 21 nt, synthetic construct
  source 1..21: mol_type = other RNA
gggccctggaagtgggtggtt

SEQ ID NO: 68 - RNA, 21 nt, synthetic construct
  source 1..21: mol_type = other RNA
ggccctggaagtgggtggatt

SEQ ID NO: 69 - RNA, 21 nt, synthetic construct
  source 1..21: mol_type = other RNA
gccctggaagtgggtggactt

SEQ ID NO: 70 - RNA, 21 nt, synthetic construct
  source 1..21: mol_type = other RNA
ccctggaagtgggtggacgtt

SEQ ID NO: 71 - RNA, 21 nt, synthetic construct
  source 1..21: mol_type = other RNA
cctggaagtgggtggacggtt

SEQ ID NO: 72 - RNA, 21 nt, synthetic construct
  source 1..21: mol_type = other RNA
ctggaagtgggtggacgggtt

SEQ ID NO: 73 - RNA, 21 nt, synthetic construct
  source 1..21: mol_type = other RNA
tggaagtgggtggacgggatt

SEQ ID NO: 74 - RNA, 21 nt, synthetic construct
  source 1..21: mol_type = other RNA
cacactcccctaagttccatt

SEQ ID NO: 75 - RNA, 21 nt, synthetic construct
  source 1..21: mol_type = other RNA
ggaagtgggtggacgggactt

SEQ ID NO: 76 - RNA, 21 nt, synthetic construct
  source 1..21: mol_type = other RNA
gaagtgggtggacgggacgtt

SEQ ID NO: 77 - RNA, 21 nt, synthetic construct
  source 1..21: mol_type = other RNA
aagtgggtggacgggacggtt

SEQ ID NO: 78 - RNA, 21 nt, synthetic construct
  source 1..21: mol_type = other RNA
agtgggtggacgggacggatt

SEQ ID NO: 79 - RNA, 21 nt, synthetic construct
  source 1..21: mol_type = other RNA
gtgggtggacgggacggactt

SEQ ID NO: 80 - RNA, 21 nt, synthetic construct
  source 1..21: mol_type = other RNA
tgggtggacgggacggacttt

SEQ ID NO: 81 - RNA, 21 nt, synthetic construct
  source 1..21: mol_type = other RNA
gggtggacgggacggactatt

SEQ ID NO: 82 - RNA, 21 nt, synthetic construct
  source 1..21: mol_type = other RNA
ggtggacgggacggactactt

SEQ ID NO: 83 - RNA, 21 nt, synthetic construct
  source 1..21: mol_type = other RNA
gtggacgggacggactacgtt

SEQ ID NO: 84 - RNA, 21 nt, synthetic construct
  source 1..21: mol_type = other RNA
tggacgggacggactacgatt

SEQ ID NO: 85 - RNA, 21 nt, synthetic construct
  source 1..21: mol_type = other RNA
acactcccctaagttccaatt

SEQ ID NO: 86 - RNA, 21 nt, synthetic construct
  source 1..21: mol_type = other RNA
ggacgggacggactacgagtt

SEQ ID NO: 87 - RNA, 21 nt, synthetic construct
  source 1..21: mol_type = other RNA
gacgggacggactacgagatt

SEQ ID NO: 88 - RNA, 21 nt, synthetic construct
  source 1..21: mol_type = other RNA
acgggacggactacgagactt

SEQ ID NO: 89 - RNA, 21 nt, synthetic construct
  source 1..21: mol_type = other RNA
cgggacggactacgagacgtt

SEQ ID NO: 90 - RNA, 21 nt, synthetic construct
  source 1..21: mol_type = other RNA
gggacggactacgagacggtt

SEQ ID NO: 91 - RNA, 21 nt, synthetic construct
  source 1..21: mol_type = other RNA
ggacggactacgagacgggtt

SEQ ID NO: 92 - RNA, 21 nt, synthetic construct
  source 1..21: mol_type = other RNA
gacggactacgagacgggctt

SEQ ID NO: 93 - RNA, 21 nt, synthetic construct
  source 1..21: mol_type = other RNA
acggactacgagacgggcttt

SEQ ID NO: 94 - RNA, 21 nt, synthetic construct
  source 1..21: mol_type = other RNA
cggactacgagacgggctttt

SEQ ID NO: 95 - RNA, 21 nt, synthetic construct
  source 1..21: mol_type = other RNA
ggactacgagacgggcttctt

SEQ ID NO: 96 - RNA, 21 nt, synthetic construct
  source 1..21: mol_type = other RNA
cactcccctaagttccaattt

SEQ ID NO: 97 - RNA, 21 nt, synthetic construct
  source 1..21: mol_type = other RNA
gactacgagacgggcttcatt

SEQ ID NO: 98 - RNA, 21 nt, synthetic construct
  source 1..21: mol_type = other RNA
actacgagacgggcttcaatt

SEQ ID NO: 99 - RNA, 21 nt, synthetic construct
  source 1..21: mol_type = other RNA
ctacgagacgggcttcaagtt

SEQ ID NO: 100 - RNA, 21 nt, synthetic construct
  source 1..21: mol_type = other RNA
tacgagacgggcttcaagatt

SEQ ID NO: 101 - RNA, 21 nt, synthetic construct
  source 1..21: mol_type = other RNA
acgagacgggcttcaagaatt

SEQ ID NO: 102 - RNA, 21 nt, synthetic construct
  source 1..21: mol_type = other RNA
cgagacgggcttcaagaactt

SEQ ID NO: 103 - RNA, 21 nt, synthetic construct
  source 1..21: mol_type = other RNA
gagacgggcttcaagaacttt

SEQ ID NO: 104 - RNA, 21 nt, synthetic construct
  source 1..21: mol_type = other RNA
agacgggcttcaagaactgtt

SEQ ID NO: 105 - RNA, 21 nt, synthetic construct
  source 1..21: mol_type = other RNA
gacgggcttcaagaactggtt

SEQ ID NO: 106 - RNA, 21 nt, synthetic construct
  source 1..21: mol_type = other RNA
acgggcttcaagaactggatt

SEQ ID NO: 107 - RNA, 21 nt, synthetic construct
  source 1..21: mol_type = other RNA
actcccctaagttccaatctt

SEQ ID NO: 108 - RNA, 21 nt, synthetic construct
  source 1..21: mol_type = other RNA
cgggcttcaagaactggagtt

SEQ ID NO: 109 - RNA, 21 nt, synthetic construct
  source 1..21: mol_type = other RNA
gggcttcaagaactggaggtt

SEQ ID NO: 110 - RNA, 21 nt, synthetic construct
  source 1..21: mol_type = other RNA
ggcttcaagaactggaggctt

SEQ ID NO: 111 - RNA, 21 nt, synthetic construct
  source 1..21: mol_type = other RNA
gcttcaagaactggaggcctt

SEQ ID NO: 112 - RNA, 21 nt, synthetic construct
  source 1..21: mol_type = other RNA
cttcaagaactggaggccgtt

SEQ ID NO: 113 - RNA, 21 nt, synthetic construct
  source 1..21: mol_type = other RNA
ttcaagaactggaggccggtt

SEQ ID NO: 114 - RNA, 21 nt, synthetic construct
  source 1..21: mol_type = other RNA
tcaagaactggaggccggatt

SEQ ID NO: 115 - RNA, 21 nt, synthetic construct
  source 1..21: mol_type = other RNA
caagaactggaggccggagtt

SEQ ID NO: 116 - RNA, 21 nt, synthetic construct
  source 1..21: mol_type = other RNA
aagaactggaggccggagctt

SEQ ID NO: 117 - RNA, 21 nt, synthetic construct
  source 1..21: mol_type = other RNA
agaactggaggccggagcatt

SEQ ID NO: 118 - RNA, 21 nt, synthetic construct
  source 1..21: mol_type = other RNA
ctcccctaagttccaatcctt

SEQ ID NO: 119 - RNA, 21 nt, synthetic construct
  source 1..21: mol_type = other RNA
gaactggaggccggagcagtt

SEQ ID NO: 120 - RNA, 21 nt, synthetic construct
  source 1..21: mol_type = other RNA
aactggaggccggagcagctt

SEQ ID NO: 121 - RNA, 21 nt, synthetic construct
  source 1..21: mol_type = other RNA
actggaggccggagcagcctt

SEQ ID NO: 122 - RNA, 21 nt, synthetic construct
  source 1..21: mol_type = other RNA
ctggaggccggagcagccgtt

SEQ ID NO: 123 - RNA, 21 nt, synthetic construct
  source 1..21: mol_type = other RNA
tggaggccggagcagccggtt

SEQ ID NO: 124 - RNA, 21 nt, synthetic construct
  source 1..21: mol_type = other RNA
ggaggccggagcagccggatt

SEQ ID NO: 125 - RNA, 21 nt, synthetic construct
  source 1..21: mol_type = other RNA
gaggccggagcagccggactt

SEQ ID NO: 126 - RNA, 21 nt, synthetic construct
  source 1..21: mol_type = other RNA
aggccggagcagccggacgtt

SEQ ID NO: 127 - RNA, 21 nt, synthetic construct
  source 1..21: mol_type = other RNA
ggccggagcagccggacgatt

SEQ ID NO: 128 - RNA, 21 nt, synthetic construct
  source 1..21: mol_type = other RNA
gccggagcagccggacgactt

SEQ ID NO: 129 - RNA, 21 nt, synthetic construct
  source 1..21: mol_type = other RNA
tcccctaagttccaatccatt

SEQ ID NO: 130 - RNA, 21 nt, synthetic construct
  source 1..21: mol_type = other RNA
ccggagcagccggacgacttt

SEQ ID NO: 131 - RNA, 21 nt, synthetic construct
  source 1..21: mol_type = other RNA
cggagcagccggacgactgtt

SEQ ID NO: 132 - RNA, 21 nt, synthetic construct
  source 1..21: mol_type = other RNA
ggagcagccggacgactggtt

SEQ ID NO: 133 - RNA, 21 nt, synthetic construct
  source 1..21: mol_type = other RNA
gagcagccggacgactggttt

SEQ ID NO: 134 - RNA, 21 nt, synthetic construct
  source 1..21: mol_type = other RNA
agcagccggacgactggtatt

SEQ ID NO: 135 - RNA, 21 nt, synthetic construct
  source 1..21: mol_type = other RNA
gcagccggacgactggtactt

SEQ ID NO: 136 - RNA, 21 nt, synthetic construct
  source 1..21: mol_type = other RNA
cagccggacgactggtacgtt

SEQ ID NO: 137 - RNA, 21 nt, synthetic construct
  source 1..21: mol_type = other RNA
agccggacgactggtacggtt

SEQ ID NO: 138 - RNA, 21 nt, synthetic construct
  source 1..21: mol_type = other RNA
gccggacgactggtacggctt

SEQ ID NO: 139 - RNA, 21 nt, synthetic construct
  source 1..21: mol_type = other RNA
ccggacgactggtacggcctt

SEQ ID NO: 140 - RNA, 21 nt, synthetic construct
  source 1..21: mol_type = other RNA
cccctaagttccaatccattt

SEQ ID NO: 141 - RNA, 21 nt, synthetic construct
  source 1..21: mol_type = other RNA
cggacgactggtacggccatt

SEQ ID NO: 142 - RNA, 21 nt, synthetic construct
  source 1..21: mol_type = other RNA
ggacgactggtacggccactt

SEQ ID NO: 143 - RNA, 21 nt, synthetic construct
  source 1..21: mol_type = other RNA
gacgactggtacggccacgtt

SEQ ID NO: 144 - RNA, 21 nt, synthetic construct
  source 1..21: mol_type = other RNA
acgactggtacggccacggtt

SEQ ID NO: 145 - RNA, 21 nt, synthetic construct
  source 1..21: mol_type = other RNA
cgactggtacggccacgggtt

SEQ ID NO: 146 - RNA, 21 nt, synthetic construct
  source 1..21: mol_type = other RNA
gactggtacggccacgggctt

SEQ ID NO: 147 - RNA, 21 nt, synthetic construct
  source 1..21: mol_type = other RNA
actggtacggccacgggcttt

SEQ ID NO: 148 - RNA, 21 nt, synthetic construct
  source 1..21: mol_type = other RNA
gcacggaagagtgaggtgatt

SEQ ID NO: 149 - RNA, 21 nt, synthetic construct
  source 1..21: mol_type = other RNA
ctggtacggccacgggctctt

SEQ ID NO: 150 - RNA, 21 nt, synthetic construct
  source 1..21: mol_type = other RNA
tggtacggccacgggctcgtt

SEQ ID NO: 151 - RNA, 21 nt, synthetic construct
  source 1..21: mol_type = other RNA
ggtacggccacgggctcggtt

SEQ ID NO: 152 - RNA, 21 nt, synthetic construct
  source 1..21: mol_type = other RNA
ccctaagttccaatccatttt

SEQ ID NO: 153 - RNA, 21 nt, synthetic construct
  source 1..21: mol_type = other RNA
gtacggccacgggctcggatt

SEQ ID NO: 154 - RNA, 21 nt, synthetic construct
  source 1..21: mol_type = other RNA
tacggccacgggctcggagtt

SEQ ID NO: 155 - RNA, 21 nt, synthetic construct
  source 1..21: mol_type = other RNA
acggccacgggctcggaggtt

SEQ ID NO: 156 - RNA, 21 nt, synthetic construct
  source 1..21: mol_type = other RNA
cggccacgggctcggaggatt

SEQ ID NO: 157 - RNA, 21 nt, synthetic construct
  source 1..21: mol_type = other RNA
ggccacgggctcggaggagtt

SEQ ID NO: 158 - RNA, 21 nt, synthetic construct
  source 1..21: mol_type = other RNA
gccacgggctcggaggaggtt

SEQ ID NO: 159 - RNA, 21 nt, synthetic construct
  source 1..21: mol_type = other RNA
ccacgggctcggaggaggctt

SEQ ID NO: 160 - RNA, 21 nt, synthetic construct
  source 1..21: mol_type = other RNA
cacgggctcggaggaggcgtt

SEQ ID NO: 161 - RNA, 21 nt, synthetic construct
  source 1..21: mol_type = other RNA
acgggctcggaggaggcgatt

SEQ ID NO: 162 - RNA, 21 nt, synthetic construct
  source 1..21: mol_type = other RNA
cgggctcggaggaggcgagtt

SEQ ID NO: 163 - RNA, 21 nt, synthetic construct
  source 1..21: mol_type = other RNA
cctaagttccaatccattttt

SEQ ID NO: 164 - RNA, 21 nt, synthetic construct
  source 1..21: mol_type = other RNA
gggctcggaggaggcgaggtt

SEQ ID NO: 165 - RNA, 21 nt, synthetic construct
  source 1..21: mol_type = other RNA
ggctcggaggaggcgaggatt

SEQ ID NO: 166 - RNA, 21 nt, synthetic construct
  source 1..21: mol_type = other RNA
gctcggaggaggcgaggactt

SEQ ID NO: 167 - RNA, 21 nt, synthetic construct
  source 1..21: mol_type = other RNA
ctcggaggaggcgaggacttt

SEQ ID NO: 168 - RNA, 21 nt, synthetic construct
  source 1..21: mol_type = other RNA
tcggaggaggcgaggactgtt

SEQ ID NO: 169 - RNA, 21 nt, synthetic construct
  source 1..21: mol_type = other RNA
cggaggaggcgaggactgttt

SEQ ID NO: 170 - RNA, 21 nt, synthetic construct
  source 1..21: mol_type = other RNA
ggaggaggcgaggactgtgtt

SEQ ID NO: 171 - RNA, 21 nt, synthetic construct
  source 1..21: mol_type = other RNA
gaggaggcgaggactgtgctt

SEQ ID NO: 172 - RNA, 21 nt, synthetic construct
  source 1..21: mol_type = other RNA
aggaggcgaggactgtgcctt

SEQ ID NO: 173 - RNA, 21 nt, synthetic construct
  source 1..21: mol_type = other RNA
ggaggcgaggactgtgccctt

SEQ ID NO: 174 - RNA, 21 nt, synthetic construct
  source 1..21: mol_type = other RNA
ctaagttccaatccatttctt

SEQ ID NO: 175 - RNA, 21 nt, synthetic construct
  source 1..21: mol_type = other RNA
gaggcgaggactgtgcccatt

SEQ ID NO: 176 - RNA, 21 nt, synthetic construct
  source 1..21: mol_type = other RNA
aggcgaggactgtgcccactt

SEQ ID NO: 177 - RNA, 21 nt, synthetic construct
  source 1..21: mol_type = other RNA
ggcgaggactgtgcccacttt

SEQ ID NO: 178 - RNA, 21 nt, synthetic construct
  source 1..21: mol_type = other RNA
gcgaggactgtgcccactttt

SEQ ID NO: 179 - RNA, 21 nt, synthetic construct
  source 1..21: mol_type = other RNA
cgaggactgtgcccacttctt

SEQ ID NO: 180 - RNA, 21 nt, synthetic construct
  source 1..21: mol_type = other RNA
gaggactgtgcccacttcatt

SEQ ID NO: 181 - RNA, 21 nt, synthetic construct
  source 1..21: mol_type = other RNA
aggactgtgcccacttcactt

SEQ ID NO: 182 - RNA, 21 nt, synthetic construct
  source 1..21: mol_type = other RNA
ggactgtgcccacttcacctt

SEQ ID NO: 183 - RNA, 21 nt, synthetic construct
  source 1..21: mol_type = other RNA
gactgtgcccacttcaccgtt

SEQ ID NO: 184 - RNA, 21 nt, synthetic construct
  source 1..21: mol_type = other RNA
actgtgcccacttcaccgatt

SEQ ID NO: 185 - RNA, 21 nt, synthetic construct
  source 1..21: mol_type = other RNA
taagttccaatccatttcctt

SEQ ID NO: 186 - RNA, 21 nt, synthetic construct
  source 1..21: mol_type = other RNA
ctgtgcccacttcaccgactt

SEQ ID NO: 187 - RNA, 21 nt, synthetic construct
  source 1..21: mol_type = other RNA
tgtgcccacttcaccgacgtt

SEQ ID NO: 188 - RNA, 21 nt, synthetic construct
  source 1..21: mol_type = other RNA
gtgcccacttcaccgacgatt

SEQ ID NO: 189 - RNA, 21 nt, synthetic construct
  source 1..21: mol_type = other RNA
tgcccacttcaccgacgactt

SEQ ID NO: 190 - RNA, 21 nt, synthetic construct
  source 1..21: mol_type = other RNA
gcccacttcaccgacgacgtt

SEQ ID NO: 191 - RNA, 21 nt, synthetic construct
  source 1..21: mol_type = other RNA
cccacttcaccgacgacggtt

SEQ ID NO: 192 - RNA, 21 nt, synthetic construct
  source 1..21: mol_type = other RNA
ccacttcaccgacgacggctt

SEQ ID NO: 193 - RNA, 21 nt, synthetic construct
  source 1..21: mol_type = other RNA
cacttcaccgacgacggcctt

SEQ ID NO: 194 - RNA, 21 nt, synthetic construct
  source 1..21: mol_type = other RNA
acttcaccgacgacggccgtt

SEQ ID NO: 195 - RNA, 21 nt, synthetic construct
  source 1..21: mol_type = other RNA
cttcaccgacgacggccgctt

SEQ ID NO: 196 - RNA, 21 nt, synthetic construct
  source 1..21: mol_type = other RNA
aagttccaatccatttccatt

SEQ ID NO: 197 - RNA, 21 nt, synthetic construct
  source 1..21: mol_type = other RNA
ttcaccgacgacggccgcttt

SEQ ID NO: 198 - RNA, 21 nt, synthetic construct
  source 1..21: mol_type = other RNA
tcaccgacgacggccgctgtt

SEQ ID NO: 199 - RNA, 21 nt, synthetic construct
  source 1..21: mol_type = other RNA
caccgacgacggccgctggtt

SEQ ID NO: 200 - RNA, 21 nt, synthetic construct
  source 1..21: mol_type = other RNA
accgacgacggccgctggatt

SEQ ID NO: 201 - RNA, 21 nt, synthetic construct
  source 1..21: mol_type = other RNA
ccgacgacggccgctggaatt

SEQ ID NO: 202 - RNA, 21 nt, synthetic construct
  source 1..21: mol_type = other RNA
cgacgacggccgctggaactt

SEQ ID NO: 203 - RNA, 21 nt, synthetic construct
  source 1..21: mol_type = other RNA
gacgacggccgctggaacgtt

SEQ ID NO: 204 - RNA, 21 nt, synthetic construct
  source 1..21: mol_type = other RNA
acgacggccgctggaacgatt

SEQ ID NO: 205 - RNA, 21 nt, synthetic construct
  source 1..21: mol_type = other RNA
cgacggccgctggaacgactt

SEQ ID NO: 206 - RNA, 21 nt, synthetic construct
  source 1..21: mol_type = other RNA
gacggccgctggaacgacgtt

SEQ ID NO: 207 - RNA, 21 nt, synthetic construct
  source 1..21: mol_type = other RNA
agttccaatccatttccactt

SEQ ID NO: 208 - RNA, 21 nt, synthetic construct
  source 1..21: mol_type = other RNA
acggccgctggaacgacgatt

SEQ ID NO: 209 - RNA, 21 nt, synthetic construct
  source 1..21: mol_type = other RNA
cggccgctggaacgacgactt

SEQ ID NO: 210 - RNA, 21 nt, synthetic construct
  source 1..21: mol_type = other RNA
ggccgctggaacgacgacgtt

SEQ ID NO: 211 - RNA, 21 nt, synthetic construct
  source 1..21: mol_type = other RNA
gccgctggaacgacgacgttt

SEQ ID NO: 212 - RNA, 21 nt, synthetic construct
  source 1..21: mol_type = other RNA
ccgctggaacgacgacgtctt

SEQ ID NO: 213 - RNA, 21 nt, synthetic construct
  source 1..21: mol_type = other RNA
cgctggaacgacgacgtcttt

SEQ ID NO: 214 - RNA, 21 nt, synthetic construct
  source 1..21: mol_type = other RNA
gctggaacgacgacgtctgtt

SEQ ID NO: 215 - RNA, 21 nt, synthetic construct
  source 1..21: mol_type = other RNA
ctggaacgacgacgtctgctt

SEQ ID NO: 216 - RNA, 21 nt, synthetic construct
  source 1..21: mol_type = other RNA
cccaaacggtgcacggaagtt

SEQ ID NO: 217 - RNA, 21 nt, synthetic construct
  source 1..21: mol_type = other RNA
tggaacgacgacgtctgcctt

SEQ ID NO: 218 - RNA, 21 nt, synthetic construct
  source 1..21: mol_type = other RNA
ggaacgacgacgtctgccatt

SEQ ID NO: 219 - RNA, 21 nt, synthetic construct
  source 1..21: mol_type = other RNA
gttccaatccatttccacctt

SEQ ID NO: 220 - RNA, 21 nt, synthetic construct
  source 1..21: mol_type = other RNA
gaacgacgacgtctgccagtt

SEQ ID NO: 221 - RNA, 21 nt, synthetic construct
  source 1..21: mol_type = other RNA
aacgacgacgtctgccagatt

SEQ ID NO: 222 - RNA, 21 nt, synthetic construct
  source 1..21: mol_type = other RNA
acgacgacgtctgccagagtt

SEQ ID NO: 223 - RNA, 21 nt, synthetic construct
  source 1..21: mol_type = other RNA
cgacgacgtctgccagaggtt

SEQ ID NO: 224 - RNA, 21 nt, synthetic construct
  source 1..21: mol_type = other RNA
gacgacgtctgccagaggctt

SEQ ID NO: 225 - RNA, 21 nt, synthetic construct
  source 1..21: mol_type = other RNA
acgacgtctgccagaggcctt

SEQ ID NO: 226 - RNA, 21 nt, synthetic construct
  source 1..21: mol_type = other RNA
cgacgtctgccagaggccctt

SEQ ID NO: 227 - RNA, 21 nt, synthetic construct
  source 1..21: mol_type = other RNA
gacgtctgccagaggcccttt

SEQ ID NO: 228 - RNA, 21 nt, synthetic construct
  source 1..21: mol_type = other RNA
acgtctgccagaggccctatt

SEQ ID NO: 229 - RNA, 21 nt, synthetic construct
  source 1..21: mol_type = other RNA
cgtctgccagaggccctactt

SEQ ID NO: 230 - RNA, 21 nt, synthetic construct
  source 1..21: mol_type = other RNA
ttccaatccatttccaccttt

SEQ ID NO: 231 - RNA, 21 nt, synthetic construct
  source 1..21: mol_type = other RNA
gtctgccagaggccctacctt

SEQ ID NO: 232 - RNA, 21 nt, synthetic construct
  source 1..21: mol_type = other RNA
tctgccagaggccctaccgtt

SEQ ID NO: 233 - RNA, 21 nt, synthetic construct
  source 1..21: mol_type = other RNA
ctgccagaggccctaccgctt

SEQ ID NO: 234 - RNA, 21 nt, synthetic construct
  source 1..21: mol_type = other RNA
tgccagaggccctaccgcttt

SEQ ID NO: 235 - RNA, 21 nt, synthetic construct
  source 1..21: mol_type = other RNA
gccagaggccctaccgctgtt

SEQ ID NO: 236 - RNA, 21 nt, synthetic construct
  source 1..21: mol_type = other RNA
ccagaggccctaccgctggtt

SEQ ID NO: 237 - RNA, 21 nt, synthetic construct
  source 1..21: mol_type = other RNA
cagaggccctaccgctgggtt

SEQ ID NO: 238 - RNA, 21 nt, synthetic construct
  source 1..21: mol_type = other RNA
agaggccctaccgctgggttt

SEQ ID NO: 239 - RNA, 21 nt, synthetic construct
  source 1..21: mol_type = other RNA
gaggccctaccgctgggtctt

SEQ ID NO: 240 - RNA, 21 nt, synthetic construct
  source 1..21: mol_type = other RNA
aggccctaccgctgggtcttt

SEQ ID NO: 241 - RNA, 21 nt, synthetic construct
  source 1..21: mol_type = other RNA
tccaatccatttccacctctt

SEQ ID NO: 242 - RNA, 21 nt, synthetic construct
  source 1..21: mol_type = other RNA
ggccctaccgctgggtctgtt

SEQ ID NO: 243 - RNA, 21 nt, synthetic construct
  source 1..21: mol_type = other RNA
gccctaccgctgggtctgctt

SEQ ID NO: 244 - RNA, 21 nt, synthetic construct
  source 1..21: mol_type = other RNA
ccctaccgctgggtctgcgtt

SEQ ID NO: 245 - RNA, 21 nt, synthetic construct
  source 1..21: mol_type = other RNA
cctaccgctgggtctgcgatt

SEQ ID NO: 246 - RNA, 21 nt, synthetic construct
  source 1..21: mol_type = other RNA
ctaccgctgggtctgcgagtt

SEQ ID NO: 247 - RNA, 21 nt, synthetic construct
  source 1..21: mol_type = other RNA
taccgctgggtctgcgagatt

SEQ ID NO: 248 - RNA, 21 nt, synthetic construct
  source 1..21: mol_type = other RNA
accgctgggtctgcgagactt

SEQ ID NO: 249 - RNA, 21 nt, synthetic construct
  source 1..21: mol_type = other RNA
ccgctgggtctgcgagacatt

SEQ ID NO: 250 - RNA, 21 nt, synthetic construct
  source 1..21: mol_type = other RNA
cgctgggtctgcgagacagtt

SEQ ID NO: 251 - RNA, 21 nt, synthetic construct
  source 1..21: mol_type = other RNA
gctgggtctgcgagacagatt

SEQ ID NO: 252 - RNA, 21 nt, synthetic construct
  source 1..21: mol_type = other RNA
ccaatccatttccacctcttt

SEQ ID NO: 253 - RNA, 21 nt, synthetic construct
  source 1..21: mol_type = other RNA
ctgggtctgcgagacagagtt

SEQ ID NO: 254 - RNA, 21 nt, synthetic construct
  source 1..21: mol_type = other RNA
tgggtctgcgagacagagctt

SEQ ID NO: 255 - RNA, 21 nt, synthetic construct
  source 1..21: mol_type = other RNA
gggtctgcgagacagagcttt

SEQ ID NO: 256 - RNA, 21 nt, synthetic construct
  source 1..21: mol_type = other RNA
ggtctgcgagacagagctgtt

SEQ ID NO: 257 - RNA, 21 nt, synthetic construct
  source 1..21: mol_type = other RNA
gtctgcgagacagagctggtt

SEQ ID NO: 258 - RNA, 21 nt, synthetic construct
  source 1..21: mol_type = other RNA
tctgcgagacagagctggatt

SEQ ID NO: 259 - RNA, 21 nt, synthetic construct
  source 1..21: mol_type = other RNA
ctgcgagacagagctggactt

SEQ ID NO: 260 - RNA, 21 nt, synthetic construct
  source 1..21: mol_type = other RNA
tgcgagacagagctggacatt

SEQ ID NO: 261 - RNA, 21 nt, synthetic construct
  source 1..21: mol_type = other RNA
cacggaagagtgaggtgactt

SEQ ID NO: 262 - RNA, 21 nt, synthetic construct
  source 1..21: mol_type = other RNA
gcgagacagagctggacaatt

SEQ ID NO: 263 - RNA, 21 nt, synthetic construct
  source 1..21: mol_type = other RNA
cgagacagagctggacaagtt

SEQ ID NO: 264 - RNA, 21 nt, synthetic construct
  source 1..21: mol_type = other RNA
caatccatttccacctctgtt

SEQ ID NO: 265 - RNA, 21 nt, synthetic construct
  source 1..21: mol_type = other RNA
gagacagagctggacaaggtt

SEQ ID NO: 266 - RNA, 21 nt, synthetic construct
  source 1..21: mol_type = other RNA
agacagagctggacaaggctt

SEQ ID NO: 267 - RNA, 21 nt, synthetic construct
  source 1..21: mol_type = other RNA
gacagagctggacaaggcctt

SEQ ID NO: 268 - RNA, 21 nt, synthetic construct
  source 1..21: mol_type = other RNA
acagagctggacaaggccatt

SEQ ID NO: 269 - RNA, 21 nt, synthetic construct
  source 1..21: mol_type = other RNA
cagagctggacaaggccagtt

SEQ ID NO: 270 - RNA, 21 nt, synthetic construct
  source 1..21: mol_type = other RNA
agagctggacaaggccagctt

SEQ ID NO: 271 - RNA, 21 nt, synthetic construct
  source 1..21: mol_type = other RNA
gagctggacaaggccagcctt

SEQ ID NO: 272 - RNA, 21 nt, synthetic construct
  source 1..21: mol_type = other RNA
agctggacaaggccagccatt

SEQ ID NO: 273 - RNA, 21 nt, synthetic construct
  source 1..21: mol_type = other RNA
gctggacaaggccagccagtt

SEQ ID NO: 274 - RNA, 21 nt, synthetic construct
  source 1..21: mol_type = other RNA
ctggacaaggccagccaggtt

SEQ ID NO: 275 - RNA, 21 nt, synthetic construct
  source 1..21: mol_type = other RNA
aatccatttccacctctgttt

SEQ ID NO: 276 - RNA, 21 nt, synthetic construct
  source 1..21: mol_type = other RNA
tggacaaggccagccaggatt

SEQ ID NO: 277 - RNA, 21 nt, synthetic construct
  source 1..21: mol_type = other RNA
ggacaaggccagccaggagtt

SEQ ID NO: 278 - RNA, 21 nt, synthetic construct
  source 1..21: mol_type = other RNA
gacaaggccagccaggagctt

SEQ ID NO: 279 - RNA, 21 nt, synthetic construct
  source 1..21: mol_type = other RNA
acaaggccagccaggagcctt

SEQ ID NO: 280 - RNA, 21 nt, synthetic construct
  source 1..21: mol_type = other RNA
caaggccagccaggagccatt

SEQ ID NO: 281 - RNA, 21 nt, synthetic construct
  source 1..21: mol_type = other RNA
aaggccagccaggagccactt

SEQ ID NO: 282 - RNA, 21 nt, synthetic construct
  source 1..21: mol_type = other RNA
aggccagccaggagccacctt

SEQ ID NO: 283 - RNA, 21 nt, synthetic construct
  source 1..21: mol_type = other RNA
ggccagccaggagccaccttt

SEQ ID NO: 284 - RNA, 21 nt, synthetic construct
  source 1..21: mol_type = other RNA
gccagccaggagccacctctt

SEQ ID NO: 285 - RNA, 21 nt, synthetic construct
  source 1..21: mol_type = other RNA
ccagccaggagccacctcttt

SEQ ID NO: 286 - RNA, 21 nt, synthetic construct
  source 1..21: mol_type = other RNA
atccatttccacctctgtttt

SEQ ID NO: 287 - RNA, 21 nt, synthetic construct
  source 1..21: mol_type = other RNA
cagccaggagccacctctctt

SEQ ID NO: 288 - RNA, 21 nt, synthetic construct
  source 1..21: mol_type = other RNA
agccaggagccacctctcctt

SEQ ID NO: 289 - RNA, 21 nt, synthetic construct
  source 1..21: mol_type = other RNA
gccaggagccacctctccttt

SEQ ID NO: 290 - RNA, 21 nt, synthetic construct
  source 1..21: mol_type = other RNA
ccaggagccacctctcctttt

SEQ ID NO: 291 - RNA, 21 nt, synthetic construct
  source 1..21: mol_type = other RNA
caggagccacctctccttttt

SEQ ID NO: 292 - RNA, 21 nt, synthetic construct
  source 1..21: mol_type = other RNA
aggagccacctctcctttatt

SEQ ID NO: 293 - RNA, 21 nt, synthetic construct
  source 1..21: mol_type = other RNA
ggagccacctctcctttaatt

SEQ ID NO: 294 - RNA, 21 nt, synthetic construct
  source 1..21: mol_type = other RNA
gagccacctctcctttaattt

SEQ ID NO: 295 - RNA, 21 nt, synthetic construct
  source 1..21: mol_type = other RNA
agccacctctcctttaatttt

SEQ ID NO: 296 - RNA, 21 nt, synthetic construct
  source 1..21: mol_type = other RNA
gccacctctcctttaattttt

SEQ ID NO: 297 - RNA, 21 nt, synthetic construct
  source 1..21: mol_type = other RNA
tccatttccacctctgttttt

SEQ ID NO: 298 - RNA, 21 nt, synthetic construct
  source 1..21: mol_type = other RNA
ccacctctcctttaatttatt

SEQ ID NO: 299 - RNA, 21 nt, synthetic construct
  source 1..21: mol_type = other RNA
cacctctcctttaatttattt

SEQ ID NO: 300 - RNA, 21 nt, synthetic construct
  source 1..21: mol_type = other RNA
acctctcctttaatttatttt

SEQ ID NO: 301 - RNA, 21 nt, synthetic construct
  source 1..21: mol_type = other RNA
cctctcctttaatttattttt

SEQ ID NO: 302 - RNA, 21 nt, synthetic construct
  source 1..21: mol_type = other RNA
ctctcctttaatttatttctt

SEQ ID NO: 303 - RNA, 21 nt, synthetic construct
  source 1..21: mol_type = other RNA
tctcctttaatttatttcttt

SEQ ID NO: 304 - RNA, 21 nt, synthetic construct
  source 1..21: mol_type = other RNA
ctcctttaatttatttctttt

SEQ ID NO: 305 - RNA, 21 nt, synthetic construct
  source 1..21: mol_type = other RNA
tcctttaatttatttcttctt

SEQ ID NO: 306 - RNA, 21 nt, synthetic construct
  source 1..21: mol_type = other RNA
cctttaatttatttcttcatt

SEQ ID NO: 307 - RNA, 21 nt, synthetic construct
  source 1..21: mol_type = other RNA
ctttaatttatttcttcaatt

SEQ ID NO: 308 - RNA, 21 nt, synthetic construct
  source 1..21: mol_type = other RNA
ccatttccacctctgtttatt

SEQ ID NO: 309 - RNA, 21 nt, synthetic construct
  source 1..21: mol_type = other RNA
tttaatttatttcttcaattt

SEQ ID NO: 310 - RNA, 21 nt, synthetic construct
  source 1..21: mol_type = other RNA
ttaatttatttcttcaatgtt

SEQ ID NO: 311 - RNA, 21 nt, synthetic construct
  source 1..21: mol_type = other RNA
taatttatttcttcaatgctt

SEQ ID NO: 312 - RNA, 21 nt, synthetic construct
  source 1..21: mol_type = other RNA
aatttatttcttcaatgcctt

SEQ ID NO: 313 - RNA, 21 nt, synthetic construct
  source 1..21: mol_type = other RNA
atttatttcttcaatgccttt

SEQ ID NO: 314 - RNA, 21 nt, synthetic construct
  source 1..21: mol_type = other RNA
tttatttcttcaatgcctctt

SEQ ID NO: 315 - RNA, 21 nt, synthetic construct
  source 1..21: mol_type = other RNA
ttatttcttcaatgcctcgtt

SEQ ID NO: 316 - RNA, 21 nt, synthetic construct
  source 1..21: mol_type = other RNA
tatttcttcaatgcctcgatt

SEQ ID NO: 317 - RNA, 21 nt, synthetic construct
  source 1..21: mol_type = other RNA
atttcttcaatgcctcgactt

SEQ ID NO: 318 - RNA, 21 nt, synthetic construct
  source 1..21: mol_type = other RNA
tttcttcaatgcctcgacctt

SEQ ID NO: 319 - RNA, 21 nt, synthetic construct
  source 1..21: mol_type = other RNA
catttccacctctgtttactt

SEQ ID NO: 320 - RNA, 21 nt, synthetic construct
  source 1..21: mol_type = other RNA
ttcttcaatgcctcgaccttt

SEQ ID NO: 321 - RNA, 21 nt, synthetic construct
  source 1..21: mol_type = other RNA
tcttcaatgcctcgacctgtt

SEQ ID NO: 322 - RNA, 21 nt, synthetic construct
  source 1..21: mol_type = other RNA
cttcaatgcctcgacctgctt

SEQ ID NO: 323 - RNA, 21 nt, synthetic construct
  source 1..21: mol_type = other RNA
ttcaatgcctcgacctgcctt

SEQ ID NO: 324 - RNA, 21 nt, synthetic construct
  source 1..21: mol_type = other RNA
tcaatgcctcgacctgccgtt

SEQ ID NO: 325 - RNA, 21 nt, synthetic construct
  source 1..21: mol_type = other RNA
caatgcctcgacctgccgctt

SEQ ID NO: 326 - RNA, 21 nt, synthetic construct
  source 1..21: mol_type = other RNA
aatgcctcgacctgccgcatt

SEQ ID NO: 327 - RNA, 21 nt, synthetic construct
  source 1..21: mol_type = other RNA
atgcctcgacctgccgcagtt

SEQ ID NO: 328 - RNA, 21 nt, synthetic construct
  source 1..21: mol_type = other RNA
tgcctcgacctgccgcaggtt

SEQ ID NO: 329 - RNA, 21 nt, synthetic construct
  source 1..21: mol_type = other RNA
gcctcgacctgccgcagggtt

SEQ ID NO: 330 - RNA, 21 nt, synthetic construct
  source 1..21: mol_type = other RNA
atttccacctctgtttacttt

SEQ ID NO: 331 - RNA, 21 nt, synthetic construct
  source 1..21: mol_type = other RNA
cctcgacctgccgcaggggtt

SEQ ID NO: 332 - RNA, 21 nt, synthetic construct
  source 1..21: mol_type = other RNA
ctcgacctgccgcaggggttt

SEQ ID NO: 333 - RNA, 21 nt, synthetic construct
  source 1..21: mol_type = other RNA
tcgacctgccgcaggggtctt

SEQ ID NO: 334 - RNA, 21 nt, synthetic construct
  source 1..21: mol_type = other RNA
cgacctgccgcaggggtcctt

SEQ ID NO: 335 - RNA, 21 nt, synthetic construct
  source 1..21: mol_type = other RNA
gacctgccgcaggggtccgtt

SEQ ID NO: 336 - RNA, 21 nt, synthetic construct
  source 1..21: mol_type = other RNA
acctgccgcaggggtccggtt

SEQ ID NO: 337 - RNA, 21 nt, synthetic construct
  source 1..21: mol_type = other RNA
cctgccgcaggggtccgggtt

SEQ ID NO: 338 - RNA, 21 nt, synthetic construct
  source 1..21: mol_type = other RNA
ctgccgcaggggtccgggatt

SEQ ID NO: 339 - RNA, 21 nt, synthetic construct
  source 1..21: mol_type = other RNA
tgccgcaggggtccgggattt

SEQ ID NO: 340 - RNA, 21 nt, synthetic construct
  source 1..21: mol_type = other RNA
gccgcaggggtccgggatttt

SEQ ID NO: 341 - RNA, 21 nt, synthetic construct
  source 1..21: mol_type = other RNA
tttccacctctgtttactgtt

SEQ ID NO: 342 - RNA, 21 nt, synthetic construct
  source 1..21: mol_type = other RNA
ccgcaggggtccgggattgtt

SEQ ID NO: 343 - RNA, 21 nt, synthetic construct
  source 1..21: mol_type = other RNA
cgcaggggtccgggattggtt

SEQ ID NO: 344 - RNA, 21 nt, synthetic construct
  source 1..21: mol_type = other RNA
gcaggggtccgggattgggtt

SEQ ID NO: 345 - RNA, 21 nt, synthetic construct
  source 1..21: mol_type = other RNA
caggggtccgggattgggatt

SEQ ID NO: 346 - RNA, 21 nt, synthetic construct
  source 1..21: mol_type = other RNA
aggggtccgggattgggaatt

SEQ ID NO: 347 - RNA, 21 nt, synthetic construct
  source 1..21: mol_type = other RNA
ggggtccgggattgggaattt

SEQ ID NO: 348 - RNA, 21 nt, synthetic construct
  source 1..21: mol_type = other RNA
gggtccgggattgggaatctt

SEQ ID NO: 349 - RNA, 21 nt, synthetic construct
  source 1..21: mol_type = other RNA
ggtccgggattgggaatcctt

SEQ ID NO: 350 - RNA, 21 nt, synthetic construct
  source 1..21: mol_type = other RNA
gtccgggattgggaatccgtt

SEQ ID NO: 351 - RNA, 21 nt, synthetic construct
  source 1..21: mol_type = other RNA
tccgggattgggaatccgctt

SEQ ID NO: 352 - RNA, 21 nt, synthetic construct
  source 1..21: mol_type = other RNA
ttccacctctgtttactgttt

SEQ ID NO: 353 - RNA, 21 nt, synthetic construct
  source 1..21: mol_type = other RNA
ccgggattgggaatccgcctt

SEQ ID NO: 354 - RNA, 21 nt, synthetic construct
  source 1..21: mol_type = other RNA
cgggattgggaatccgccctt

SEQ ID NO: 355 - RNA, 21 nt, synthetic construct
  source 1..21: mol_type = other RNA
gggattgggaatccgcccatt

SEQ ID NO: 356 - RNA, 21 nt, synthetic construct
  source 1..21: mol_type = other RNA
ggattgggaatccgcccattt

SEQ ID NO: 357 - RNA, 21 nt, synthetic construct
  source 1..21: mol_type = other RNA
gattgggaatccgcccatctt

SEQ ID NO: 358 - RNA, 21 nt, synthetic construct
  source 1..21: mol_type = other RNA
attgggaatccgcccatcttt

SEQ ID NO: 359 - RNA, 21 nt, synthetic construct
  source 1..21: mol_type = other RNA
ttgggaatccgcccatctgtt

SEQ ID NO: 360 - RNA, 21 nt, synthetic construct
  source 1..21: mol_type = other RNA
tgggaatccgcccatctggtt

SEQ ID NO: 361 - RNA, 21 nt, synthetic construct
  source 1..21: mol_type = other RNA
gggaatccgcccatctgggtt

SEQ ID NO: 362 - RNA, 21 nt, synthetic construct
  source 1..21: mol_type = other RNA
ggaatccgcccatctggggtt

SEQ ID NO: 363 - RNA, 21 nt, synthetic construct
  source 1..21: mol_type = other RNA
tccacctctgtttactgtctt

SEQ ID NO: 364 - RNA, 21 nt, synthetic construct
  source 1..21: mol_type = other RNA
gaatccgcccatctgggggtt

SEQ ID NO: 365 - RNA, 21 nt, synthetic construct
  source 1..21: mol_type = other RNA
aatccgcccatctgggggctt

SEQ ID NO: 366 - RNA, 21 nt, synthetic construct
  source 1..21: mol_type = other RNA
atccgcccatctgggggcctt

SEQ ID NO: 367 - RNA, 21 nt, synthetic construct
  source 1..21: mol_type = other RNA
tccgcccatctgggggccttt

SEQ ID NO: 368 - RNA, 21 nt, synthetic construct
  source 1..21: mol_type = other RNA
ccgcccatctgggggcctctt

SEQ ID NO: 369 - RNA, 21 nt, synthetic construct
  source 1..21: mol_type = other RNA
cgcccatctgggggcctcttt

SEQ ID NO: 370 - RNA, 21 nt, synthetic construct
  source 1..21: mol_type = other RNA
gcccatctgggggcctctttt

SEQ ID NO: 371 - RNA, 21 nt, synthetic construct
  source 1..21: mol_type = other RNA
cccatctgggggcctcttctt

SEQ ID NO: 372 - RNA, 21 nt, synthetic construct
  source 1..21: mol_type = other RNA
ccatctgggggcctcttcttt

SEQ ID NO: 373 - RNA, 21 nt, synthetic construct
  source 1..21: mol_type = other RNA
acggaagagtgaggtgacttt

SEQ ID NO: 374 - RNA, 21 nt, synthetic construct
  source 1..21: mol_type = other RNA
catctgggggcctcttctgtt

SEQ ID NO: 375 - RNA, 21 nt, synthetic construct
  source 1..21: mol_type = other RNA
ccacctctgtttactgtcctt

SEQ ID NO: 376 - RNA, 21 nt, synthetic construct
  source 1..21: mol_type = other RNA
atctgggggcctcttctgctt

SEQ ID NO: 377 - RNA, 21 nt, synthetic construct
  source 1..21: mol_type = other RNA
tctgggggcctcttctgcttt

SEQ ID NO: 378 - RNA, 21 nt, synthetic construct
  source 1..21: mol_type = other RNA
ctgggggcctcttctgctttt

SEQ ID NO: 379 - RNA, 21 nt, synthetic construct
  source 1..21: mol_type = other RNA
tgggggcctcttctgcttttt

SEQ ID NO: 380 - RNA, 21 nt, synthetic construct
  source 1..21: mol_type = other RNA
gggggcctcttctgctttctt

SEQ ID NO: 381 - RNA, 21 nt, synthetic construct
  source 1..21: mol_type = other RNA
ggggcctcttctgctttcttt

SEQ ID NO: 382 - RNA, 21 nt, synthetic construct
  source 1..21: mol_type = other RNA
gggcctcttctgctttctctt

SEQ ID NO: 383 - RNA, 21 nt, synthetic construct
  source 1..21: mol_type = other RNA
ggcctcttctgctttctcgtt

SEQ ID NO: 384 - RNA, 21 nt, synthetic construct
  source 1..21: mol_type = other RNA
gcctcttctgctttctcggtt

SEQ ID NO: 385 - RNA, 21 nt, synthetic construct
  source 1..21: mol_type = other RNA
cctcttctgctttctcgggtt

SEQ ID NO: 386 - RNA, 21 nt, synthetic construct
  source 1..21: mol_type = other RNA
cacctctgtttactgtccatt

SEQ ID NO: 387 - RNA, 21 nt, synthetic construct
  source 1..21: mol_type = other RNA
ctcttctgctttctcgggatt

SEQ ID NO: 388 - RNA, 21 nt, synthetic construct
  source 1..21: mol_type = other RNA
tcttctgctttctcgggaatt

SEQ ID NO: 389 - RNA, 21 nt, synthetic construct
  source 1..21: mol_type = other RNA
cttctgctttctcgggaattt

SEQ ID NO: 390 - RNA, 21 nt, synthetic construct
  source 1..21: mol_type = other RNA
ttctgctttctcgggaatttt

SEQ ID NO: 391 - RNA, 21 nt, synthetic construct
  source 1..21: mol_type = other RNA
tctgctttctcgggaattttt

SEQ ID NO: 392 - RNA, 21 nt, synthetic construct
  source 1..21: mol_type = other RNA
ctgctttctcgggaatttttt

SEQ ID NO: 393 - RNA, 21 nt, synthetic construct
  source 1..21: mol_type = other RNA
tgctttctcgggaattttctt

SEQ ID NO: 394 - RNA, 21 nt, synthetic construct
  source 1..21: mol_type = other RNA
gctttctcgggaattttcatt

SEQ ID NO: 395 - RNA, 21 nt, synthetic construct
  source 1..21: mol_type = other RNA
ctttctcgggaattttcattt

SEQ ID NO: 396 - RNA, 21 nt, synthetic construct
  source 1..21: mol_type = other RNA
tttctcgggaattttcatctt

SEQ ID NO: 397 - RNA, 21 nt, synthetic construct
  source 1..21: mol_type = other RNA
acctctgtttactgtccaatt

SEQ ID NO: 398 - RNA, 21 nt, synthetic construct
  source 1..21: mol_type = other RNA
ttctcgggaattttcatcttt

SEQ ID NO: 399 - RNA, 21 nt, synthetic construct
  source 1..21: mol_type = other RNA
tctcgggaattttcatctatt

SEQ ID NO: 400 - RNA, 21 nt, synthetic construct
  source 1..21: mol_type = other RNA
ctcgggaattttcatctagtt

SEQ ID NO: 401 - RNA, 21 nt, synthetic construct
  source 1..21: mol_type = other RNA
tcgggaattttcatctaggtt

SEQ ID NO: 402 - RNA, 21 nt, synthetic construct
  source 1..21: mol_type = other RNA
cgggaattttcatctaggatt

SEQ ID NO: 403 - RNA, 21 nt, synthetic construct
  source 1..21: mol_type = other RNA
gggaattttcatctaggattt

SEQ ID NO: 404 - RNA, 21 nt, synthetic construct
  source 1..21: mol_type = other RNA
ggaattttcatctaggatttt

SEQ ID NO: 405 - RNA, 21 nt, synthetic construct
  source 1..21: mol_type = other RNA
gaattttcatctaggattttt

SEQ ID NO: 406 - RNA, 21 nt, synthetic construct
  source 1..21: mol_type = other RNA
aattttcatctaggatttttt

SEQ ID NO: 407 - RNA, 21 nt, synthetic construct
  source 1..21: mol_type = other RNA
attttcatctaggattttatt

SEQ ID NO: 408 - RNA, 21 nt, synthetic construct
  source 1..21: mol_type = other RNA
cctctgtttactgtccaaatt

SEQ ID NO: 409 - RNA, 21 nt, synthetic construct
  source 1..21: mol_type = other RNA
ttttcatctaggattttaatt

SEQ ID NO: 410 - RNA, 21 nt, synthetic construct
  source 1..21: mol_type = other RNA
tttcatctaggattttaagtt

SEQ ID NO: 411 - RNA, 21 nt, synthetic construct
  source 1..21: mol_type = other RNA
ttcatctaggattttaaggtt

SEQ ID NO: 412 - RNA, 21 nt, synthetic construct
  source 1..21: mol_type = other RNA
tcatctaggattttaagggtt

SEQ ID NO: 413 - RNA, 21 nt, synthetic construct
  source 1..21: mol_type = other RNA
catctaggattttaagggatt

SEQ ID NO: 414 - RNA, 21 nt, synthetic construct
  source 1..21: mol_type = other RNA
atctaggattttaagggaatt

SEQ ID NO: 415 - RNA, 21 nt, synthetic construct
  source 1..21: mol_type = other RNA
tctaggattttaagggaagtt

SEQ ID NO: 416 - RNA, 21 nt, synthetic construct
  source 1..21: mol_type = other RNA
ctaggattttaagggaaggtt

SEQ ID NO: 417 - RNA, 21 nt, synthetic construct
  source 1..21: mol_type = other RNA
taggattttaagggaagggtt

SEQ ID NO: 418 - RNA, 21 nt, synthetic construct
  source 1..21: mol_type = other RNA
aggattttaagggaaggggtt

SEQ ID NO: 419 - RNA, 21 nt, synthetic construct
  source 1..21: mol_type = other RNA
ctctgtttactgtccaaagtt

SEQ ID NO: 420 - RNA, 21 nt, synthetic construct
  source 1..21: mol_type = other RNA
ggattttaagggaaggggatt

SEQ ID NO: 421 - RNA, 21 nt, synthetic construct
  source 1..21: mol_type = other RNA
gattttaagggaaggggaatt

SEQ ID NO: 422 - RNA, 21 nt, synthetic construct
  source 1..21: mol_type = other RNA
attttaagggaaggggaagtt

SEQ ID NO: 423 - RNA, 21 nt, synthetic construct
  source 1..21: mol_type = other RNA
ttttaagggaaggggaaggtt

SEQ ID NO: 424 - RNA, 21 nt, synthetic construct
  source 1..21: mol_type = other RNA
tttaagggaaggggaaggatt

SEQ ID NO: 425 - RNA, 21 nt, synthetic construct
  source 1..21: mol_type = other RNA
ttaagggaaggggaaggattt

SEQ ID NO: 426 - RNA, 21 nt, synthetic construct
  source 1..21: mol_type = other RNA
taagggaaggggaaggatatt

SEQ ID NO: 427 - RNA, 21 nt, synthetic construct
  source 1..21: mol_type = other RNA
aagggaaggggaaggatagtt

SEQ ID NO: 428 - RNA, 21 nt, synthetic construct
  source 1..21: mol_type = other RNA
agggaaggggaaggataggtt

SEQ ID NO: 429 - RNA, 21 nt, synthetic construct
  source 1..21: mol_type = other RNA
gggaaggggaaggatagggtt

SEQ ID NO: 430 - RNA, 21 nt, synthetic construct
  source 1..21: mol_type = other RNA
tctgtttactgtccaaagttt

SEQ ID NO: 431 - RNA, 21 nt, synthetic construct
  source 1..21: mol_type = other RNA
ggaaggggaaggatagggttt

SEQ ID NO: 432 - RNA, 21 nt, synthetic construct
  source 1..21: mol_type = other RNA
gaaggggaaggatagggtgtt

SEQ ID NO: 433 - RNA, 21 nt, synthetic construct
  source 1..21: mol_type = other RNA
aaggggaaggatagggtgatt

SEQ ID NO: 434 - RNA, 21 nt, synthetic construct
  source 1..21: mol_type = other RNA
aggggaaggatagggtgattt

SEQ ID NO: 435 - RNA, 21 nt, synthetic construct
  source 1..21: mol_type = other RNA
ggggaaggatagggtgatgtt

SEQ ID NO: 436 - RNA, 21 nt, synthetic construct
  source 1..21: mol_type = other RNA
gggaaggatagggtgatgttt

SEQ ID NO: 437 - RNA, 21 nt, synthetic construct
  source 1..21: mol_type = other RNA
ggaaggatagggtgatgtttt

SEQ ID NO: 438 - RNA, 21 nt, synthetic construct
  source 1..21: mol_type = other RNA
gaaggatagggtgatgttctt

SEQ ID NO: 439 - RNA, 21 nt, synthetic construct
  source 1..21: mol_type = other RNA
aaggatagggtgatgttcctt

SEQ ID NO: 440 - RNA, 21 nt, synthetic construct
  source 1..21: mol_type = other RNA
aggatagggtgatgttccgtt

SEQ ID NO: 441 - RNA, 21 nt, synthetic construct
  source 1..21: mol_type = other RNA
ctgtttactgtccaaagtctt

SEQ ID NO: 442 - RNA, 21 nt, synthetic construct
  source 1..21: mol_type = other RNA
ggatagggtgatgttccgatt

SEQ ID NO: 443 - RNA, 21 nt, synthetic construct
  source 1..21: mol_type = other RNA
gatagggtgatgttccgaatt

SEQ ID NO: 444 - RNA, 21 nt, synthetic construct
  source 1..21: mol_type = other RNA
atagggtgatgttccgaagtt

SEQ ID NO: 445 - RNA, 21 nt, synthetic construct
  source 1..21: mol_type = other RNA
tagggtgatgttccgaaggtt

SEQ ID NO: 446 - RNA, 21 nt, synthetic construct
  source 1..21: mol_type = other RNA
agggtgatgttccgaaggttt

SEQ ID NO: 447 - RNA, 21 nt, synthetic construct
  source 1..21: mol_type = other RNA
gggtgatgttccgaaggtgtt

SEQ ID NO: 448 - RNA, 21 nt, synthetic construct
  source 1..21: mol_type = other RNA
ggtgatgttccgaaggtgatt

SEQ ID NO: 449 - RNA, 21 nt, synthetic construct
  source 1..21: mol_type = other RNA
gtgatgttccgaaggtgagtt

SEQ ID NO: 450 - RNA, 21 nt, synthetic construct
  source 1..21: mol_type = other RNA
tgatgttccgaaggtgaggtt

SEQ ID NO: 451 - RNA, 21 nt, synthetic construct
  source 1..21: mol_type = other RNA
gatgttccgaaggtgaggatt

SEQ ID NO: 452 - RNA, 21 nt, synthetic construct
  source 1..21: mol_type = other RNA
tgtttactgtccaaagtcctt

SEQ ID NO: 453 - RNA, 21 nt, synthetic construct
  source 1..21: mol_type = other RNA
atgttccgaaggtgaggagtt

SEQ ID NO: 454 - RNA, 21 nt, synthetic construct
  source 1..21: mol_type = other RNA
tgttccgaaggtgaggagctt

SEQ ID NO: 455 - RNA, 21 nt, synthetic construct
  source 1..21: mol_type = other RNA
gttccgaaggtgaggagcttt

SEQ ID NO: 456 - RNA, 21 nt, synthetic construct
  source 1..21: mol_type = other RNA
ttccgaaggtgaggagctttt

SEQ ID NO: 457 - RNA, 21 nt, synthetic construct
  source 1..21: mol_type = other RNA
tccgaaggtgaggagcttgtt

SEQ ID NO: 458 - RNA, 21 nt, synthetic construct
  source 1..21: mol_type = other RNA
ccgaaggtgaggagcttgatt

SEQ ID NO: 459 - RNA, 21 nt, synthetic construct
  source 1..21: mol_type = other RNA
cgaaggtgaggagcttgaatt

SEQ ID NO: 460 - RNA, 21 nt, synthetic construct
  source 1..21: mol_type = other RNA
gaaggtgaggagcttgaaatt

SEQ ID NO: 461 - RNA, 21 nt, synthetic construct
  source 1..21: mol_type = other RNA
aaggtgaggagcttgaaactt

SEQ ID NO: 462 - RNA, 21 nt, synthetic construct
  source 1..21: mol_type = other RNA
aggtgaggagcttgaaacctt

SEQ ID NO: 463 - RNA, 21 nt, synthetic construct
  source 1..21: mol_type = other RNA
gtttactgtccaaagtccctt

SEQ ID NO: 464 - RNA, 21 nt, synthetic construct
  source 1..21: mol_type = other RNA
ggtgaggagcttgaaaccctt

SEQ ID NO: 465 - RNA, 21 nt, synthetic construct
  source 1..21: mol_type = other RNA
gtgaggagcttgaaacccgtt

SEQ ID NO: 466 - RNA, 21 nt, synthetic construct
  source 1..21: mol_type = other RNA
tgaggagcttgaaacccgttt

SEQ ID NO: 467 - RNA, 21 nt, synthetic construct
  source 1..21: mol_type = other RNA
gaggagcttgaaacccgtgtt

SEQ ID NO: 468 - RNA, 21 nt, synthetic construct
  source 1..21: mol_type = other RNA
aggagcttgaaacccgtggtt

SEQ ID NO: 469 - RNA, 21 nt, synthetic construct
  source 1..21: mol_type = other RNA
ggagcttgaaacccgtggctt

SEQ ID NO: 470 - RNA, 21 nt, synthetic construct
  source 1..21: mol_type = other RNA
gagcttgaaacccgtggcgtt

SEQ ID NO: 471 - RNA, 21 nt, synthetic construct
  source 1..21: mol_type = other RNA
agcttgaaacccgtggcgctt

SEQ ID NO: 472 - RNA, 21 nt, synthetic construct
  source 1..21: mol_type = other RNA
gcttgaaacccgtggcgcttt

SEQ ID NO: 473 - RNA, 21 nt, synthetic construct
  source 1..21: mol_type = other RNA
cttgaaacccgtggcgctttt

SEQ ID NO: 474 - RNA, 21 nt, synthetic construct
  source 1..21: mol_type = other RNA
tttactgtccaaagtcccgtt

SEQ ID NO: 475 - RNA, 21 nt, synthetic construct
  source 1..21: mol_type = other RNA
ttgaaacccgtggcgcttttt

SEQ ID NO: 476 - RNA, 21 nt, synthetic construct
  source 1..21: mol_type = other RNA
tgaaacccgtggcgctttctt

SEQ ID NO: 477 - RNA, 21 nt, synthetic construct
  source 1..21: mol_type = other RNA
gaaacccgtggcgctttcttt

SEQ ID NO: 478 - RNA, 21 nt, synthetic construct
  source 1..21: mol_type = other RNA
aaacccgtggcgctttctgtt

SEQ ID NO: 479 - RNA, 21 nt, synthetic construct
  source 1..21: mol_type = other RNA
aacccgtggcgctttctgctt

SEQ ID NO: 480 - RNA, 21 nt, synthetic construct
  source 1..21: mol_type = other RNA
acccgtggcgctttctgcatt

SEQ ID NO: 481 - RNA, 21 nt, synthetic construct
  source 1..21: mol_type = other RNA
cccgtggcgctttctgcagtt

SEQ ID NO: 482 - RNA, 21 nt, synthetic construct
  source 1..21: mol_type = other RNA
ccgtggcgctttctgcagttt

SEQ ID NO: 483 - RNA, 21 nt, synthetic construct
  source 1..21: mol_type = other RNA
cgtggcgctttctgcagtttt

SEQ ID NO: 484 - RNA, 21 nt, synthetic construct
  source 1..21: mol_type = other RNA
gtggcgctttctgcagttttt

SEQ ID NO: 485 - RNA, 21 nt, synthetic construct
  source 1..21: mol_type = other RNA
ttactgtccaaagtcccggtt

SEQ ID NO: 486 - RNA, 21 nt, synthetic construct
  source 1..21: mol_type = other RNA
cggaagagtgaggtgactgtt

SEQ ID NO: 487 - RNA, 21 nt, synthetic construct
  source 1..21: mol_type = other RNA
tggcgctttctgcagtttgtt

SEQ ID NO: 488 - RNA, 21 nt, synthetic construct
  source 1..21: mol_type = other RNA
ggcgctttctgcagtttgctt

SEQ ID NO: 489 - RNA, 21 nt, synthetic construct
  source 1..21: mol_type = other RNA
gcgctttctgcagtttgcatt

SEQ ID NO: 490 - RNA, 21 nt, synthetic construct
  source 1..21: mol_type = other RNA
cgctttctgcagtttgcagtt

SEQ ID NO: 491 - RNA, 21 nt, synthetic construct
  source 1..21: mol_type = other RNA
gctttctgcagtttgcaggtt

SEQ ID NO: 492 - RNA, 21 nt, synthetic construct
  source 1..21: mol_type = other RNA
ctttctgcagtttgcaggttt

SEQ ID NO: 493 - RNA, 21 nt, synthetic construct
  source 1..21: mol_type = other RNA
tttctgcagtttgcaggtttt

SEQ ID NO: 494 - RNA, 21 nt, synthetic construct
  source 1..21: mol_type = other RNA
ttctgcagtttgcaggttatt

SEQ ID NO: 495 - RNA, 21 nt, synthetic construct
  source 1..21: mol_type = other RNA
tctgcagtttgcaggttattt

SEQ ID NO: 496 - RNA, 21 nt, synthetic construct
  source 1..21: mol_type = other RNA
ctgcagtttgcaggttatctt

SEQ ID NO: 497 - RNA, 21 nt, synthetic construct
  source 1..21: mol_type = other RNA
tactgtccaaagtcccgggtt

SEQ ID NO: 498 - RNA, 21 nt, synthetic construct
  source 1..21: mol_type = other RNA
tgcagtttgcaggttatcatt

SEQ ID NO: 499 - RNA, 21 nt, synthetic construct
  source 1..21: mol_type = other RNA
gcagtttgcaggttatcattt

SEQ ID NO: 500 - RNA, 21 nt, synthetic construct
  source 1..21: mol_type = other RNA
cagtttgcaggttatcatttt

SEQ ID NO: 501 - RNA, 21 nt, synthetic construct
  source 1..21: mol_type = other RNA
agtttgcaggttatcattgtt

SEQ ID NO: 502 - RNA, 21 nt, synthetic construct
  source 1..21: mol_type = other RNA
gtttgcaggttatcattgttt

SEQ ID NO: 503 - RNA, 21 nt, synthetic construct
  source 1..21: mol_type = other RNA
tttgcaggttatcattgtgtt

SEQ ID NO: 504 - RNA, 21 nt, synthetic construct
  source 1..21: mol_type = other RNA
ttgcaggttatcattgtgatt

SEQ ID NO: 505 - RNA, 21 nt, synthetic construct
  source 1..21: mol_type = other RNA
tgcaggttatcattgtgaatt

SEQ ID NO: 506 - RNA, 21 nt, synthetic construct
  source 1..21: mol_type = other RNA
gcaggttatcattgtgaactt

SEQ ID NO: 507 - RNA, 21 nt, synthetic construct
  source 1..21: mol_type = other RNA
caggttatcattgtgaacttt

SEQ ID NO: 508 - RNA, 21 nt, synthetic construct
  source 1..21: mol_type = other RNA
actgtccaaagtcccgggctt

SEQ ID NO: 509 - RNA, 21 nt, synthetic construct
  source 1..21: mol_type = other RNA
aggttatcattgtgaactttt

SEQ ID NO: 510 - RNA, 21 nt, synthetic construct
  source 1..21: mol_type = other RNA
ggttatcattgtgaacttttt

SEQ ID NO: 511 - RNA, 21 nt, synthetic construct
  source 1..21: mol_type = other RNA
gttatcattgtgaactttttt

SEQ ID NO: 512 - RNA, 21 nt, synthetic construct
  source 1..21: mol_type = other RNA
ttatcattgtgaacttttttt

SEQ ID NO: 513 - RNA, 21 nt, synthetic construct
  source 1..21: mol_type = other RNA
tatcattgtgaactttttttt

SEQ ID NO: 514 - RNA, 21 nt, synthetic construct
  source 1..21: mol_type = other RNA
atcattgtgaacttttttttt

SEQ ID NO: 515 - RNA, 21 nt, synthetic construct
  source 1..21: mol_type = other RNA
tcattgtgaactttttttttt

SEQ ID NO: 516 - RNA, 21 nt, synthetic construct
  source 1..21: mol_type = other RNA
cattgtgaacttttttttttt

SEQ ID NO: 517 - RNA, 21 nt, synthetic construct
  source 1..21: mol_type = other RNA
attgtgaactttttttttttt

SEQ ID NO: 518 - RNA, 21 nt, synthetic construct
  source 1..21: mol_type = other RNA
ttgtgaacttttttttttttt

SEQ ID NO: 519 - RNA, 21 nt, synthetic construct
  source 1..21: mol_type = other RNA
ctgtccaaagtcccgggcatt

SEQ ID NO: 520 - RNA, 21 nt, synthetic construct
  source 1..21: mol_type = other RNA
tgtgaactttttttttttatt

SEQ ID NO: 521 - RNA, 21 nt, synthetic construct
  source 1..21: mol_type = other RNA
gtgaactttttttttttaatt

SEQ ID NO: 522 - RNA, 21 nt, synthetic construct
  source 1..21: mol_type = other RNA
tgaactttttttttttaagtt

SEQ ID NO: 523 - RNA, 21 nt, synthetic construct
  source 1..21: mol_type = other RNA
gaactttttttttttaagatt

SEQ ID NO: 524 - RNA, 21 nt, synthetic construct
  source 1..21: mol_type = other RNA
aactttttttttttaagagtt

SEQ ID NO: 525 - RNA, 21 nt, synthetic construct
  source 1..21: mol_type = other RNA
actttttttttttaagagttt

SEQ ID NO: 526 - RNA, 21 nt, synthetic construct
  source 1..21: mol_type = other RNA
ctttttttttttaagagtatt

SEQ ID NO: 527 - RNA, 21 nt, synthetic construct
  source 1..21: mol_type = other RNA
tttttttttttaagagtaatt

SEQ ID NO: 528 - RNA, 21 nt, synthetic construct
  source 1..21: mol_type = other RNA
ttttttttttaagagtaaatt

SEQ ID NO: 529 - RNA, 21 nt, synthetic construct
  source 1..21: mol_type = other RNA
tttttttttaagagtaaaatt

SEQ ID NO: 530 - RNA, 21 nt, synthetic construct
  source 1..21: mol_type = other RNA
tgtccaaagtcccgggcactt

SEQ ID NO: 531 - RNA, 21 nt, synthetic construct
  source 1..21: mol_type = other RNA
ttttttttaagagtaaaaatt

SEQ ID NO: 532 - RNA, 21 nt, synthetic construct
  source 1..21: mol_type = other RNA
tttttttaagagtaaaaagtt

SEQ ID NO: 533 - RNA, 21 nt, synthetic construct
  source 1..21: mol_type = other RNA
ttttttaagagtaaaaagatt

SEQ ID NO: 534 - RNA, 21 nt, synthetic construct
  source 1..21: mol_type = other RNA
tttttaagagtaaaaagaatt

SEQ ID NO: 535 - RNA, 21 nt, synthetic construct
  source 1..21: mol_type = other RNA
ttttaagagtaaaaagaaatt

SEQ ID NO: 536 - RNA, 21 nt, synthetic construct
  source 1..21: mol_type = other RNA
tttaagagtaaaaagaaattt

SEQ ID NO: 537 - RNA, 21 nt, synthetic construct
  source 1..21: mol_type = other RNA
ttaagagtaaaaagaaatatt

SEQ ID NO: 538 - RNA, 21 nt, synthetic construct
  source 1..21: mol_type = other RNA
taagagtaaaaagaaatattt

SEQ ID NO: 539 - RNA, 21 nt, synthetic construct
  source 1..21: mol_type = other RNA
aagagtaaaaagaaatatatt

SEQ ID NO: 540 - RNA, 21 nt, synthetic construct
  source 1..21: mol_type = other RNA
agagtaaaaagaaatatactt

SEQ ID NO: 541 - RNA, 21 nt, synthetic construct
  source 1..21: mol_type = other RNA
gtccaaagtcccgggcacttt

SEQ ID NO: 542 - RNA, 21 nt, synthetic construct
  source 1..21: mol_type = other RNA
gagtaaaaagaaatatacctt

SEQ ID NO: 543 - RNA, 21 nt, synthetic construct
  source 1..21: mol_type = other RNA
agtaaaaagaaatataccttt

SEQ ID NO: 544 - RNA, 21 nt, synthetic construct
  source 1..21: mol_type = other RNA
gtaaaaagaaatatacctatt

SEQ ID NO: 545 - RNA, 21 nt, synthetic construct
  source 1..21: mol_type = other RNA
taaaaagaaatatacctaatt

SEQ ID NO: 546 - RNA, 21 nt, synthetic construct
  source 1..21: mol_type = other RNA
tccaaagtcccgggcactgtt

SEQ ID NO: 547 - RNA, 21 nt, synthetic construct
  source 1..21: mol_type = other RNA
ccaaagtcccgggcactggtt

SEQ ID NO: 548 - RNA, 21 nt, synthetic construct
  source 1..21: mol_type = other RNA
caaagtcccgggcactggatt

SEQ ID NO: 549 - RNA, 21 nt, synthetic construct
  source 1..21: mol_type = other RNA
aaagtcccgggcactggagtt

SEQ ID NO: 550 - RNA, 21 nt, synthetic construct
  source 1..21: mol_type = other RNA
aagtcccgggcactggagatt

SEQ ID NO: 551 - RNA, 21 nt, synthetic construct
  source 1..21: mol_type = other RNA
ggaagagtgaggtgactggtt

SEQ ID NO: 552 - RNA, 21 nt, synthetic construct
  source 1..21: mol_type = other RNA
agtcccgggcactggagattt

SEQ ID NO: 553 - RNA, 21 nt, synthetic construct
  source 1..21: mol_type = other RNA
gtcccgggcactggagatgtt

SEQ ID NO: 554 - RNA, 21 nt, synthetic construct
  source 1..21: mol_type = other RNA
tcccgggcactggagatgctt

SEQ ID NO: 555 - RNA, 21 nt, synthetic construct
  source 1..21: mol_type = other RNA
cccgggcactggagatgcctt

SEQ ID NO: 556 - RNA, 21 nt, synthetic construct
  source 1..21: mol_type = other RNA
ccgggcactggagatgccatt

SEQ ID NO: 557 - RNA, 21 nt, synthetic construct
  source 1..21: mol_type = other RNA
cgggcactggagatgccactt

SEQ ID NO: 558 - RNA, 21 nt, synthetic construct
  source 1..21: mol_type = other RNA
gggcactggagatgccacgtt

SEQ ID NO: 559 - RNA, 21 nt, synthetic construct
  source 1..21: mol_type = other RNA
ggcactggagatgccacgttt

SEQ ID NO: 560 - RNA, 21 nt, synthetic construct
  source 1..21: mol_type = other RNA
gcactggagatgccacgtttt

SEQ ID NO: 561 - RNA, 21 nt, synthetic construct
  source 1..21: mol_type = other RNA
cactggagatgccacgttttt

SEQ ID NO: 562 - RNA, 21 nt, synthetic construct
  source 1..21: mol_type = other RNA
gaagagtgaggtgactggctt

SEQ ID NO: 563 - RNA, 21 nt, synthetic construct
  source 1..21: mol_type = other RNA
actggagatgccacgtttgtt

SEQ ID NO: 564 - RNA, 21 nt, synthetic construct
  source 1..21: mol_type = other RNA
ctggagatgccacgtttggtt

SEQ ID NO: 565 - RNA, 21 nt, synthetic construct
  source 1..21: mol_type = other RNA
tggagatgccacgtttggctt

SEQ ID NO: 566 - RNA, 21 nt, synthetic construct
  source 1..21: mol_type = other RNA
ggagatgccacgtttggcgtt

SEQ ID NO: 567 - RNA, 21 nt, synthetic construct
  source 1..21: mol_type = other RNA
gagatgccacgtttggcgttt

SEQ ID NO: 568 - RNA, 21 nt, synthetic construct
  source 1..21: mol_type = other RNA
agatgccacgtttggcgtgtt

SEQ ID NO: 569 - RNA, 21 nt, synthetic construct
  source 1..21: mol_type = other RNA
gatgccacgtttggcgtgctt

SEQ ID NO: 570 - RNA, 21 nt, synthetic construct
  source 1..21: mol_type = other RNA
atgccacgtttggcgtgcttt

SEQ ID NO: 571 - RNA, 21 nt, synthetic construct
  source 1..21: mol_type = other RNA
tgccacgtttggcgtgctttt

SEQ ID NO: 572 - RNA, 21 nt, synthetic construct
  source 1..21: mol_type = other RNA
gccacgtttggcgtgcttgtt

SEQ ID NO: 573 - RNA, 21 nt, synthetic construct
  source 1..21: mol_type = other RNA
aagagtgaggtgactggcatt

SEQ ID NO: 574 - RNA, 21 nt, synthetic construct
  source 1..21: mol_type = other RNA
ccacgtttggcgtgcttggtt

SEQ ID NO: 575 - RNA, 21 nt, synthetic construct
  source 1..21: mol_type = other RNA
cacgtttggcgtgcttggatt

SEQ ID NO: 576 - RNA, 21 nt, synthetic construct
  source 1..21: mol_type = other RNA
acgtttggcgtgcttggactt

SEQ ID NO: 577 - RNA, 21 nt, synthetic construct
  source 1..21: mol_type = other RNA
cgtttggcgtgcttggacatt

SEQ ID NO: 578 - RNA, 21 nt, synthetic construct
  source 1..21: mol_type = other RNA
gtttggcgtgcttggacactt

SEQ ID NO: 579 - RNA, 21 nt, synthetic construct
  source 1..21: mol_type = other RNA
tttggcgtgcttggacacatt

SEQ ID NO: 580 - RNA, 21 nt, synthetic construct
  source 1..21: mol_type = other RNA
ttggcgtgcttggacacactt

SEQ ID NO: 581 - RNA, 21 nt, synthetic construct
  source 1..21: mol_type = other RNA
tggcgtgcttggacacacatt

SEQ ID NO: 582 - RNA, 21 nt, synthetic construct
  source 1..21: mol_type = other RNA
ggcgtgcttggacacacagtt

SEQ ID NO: 583 - RNA, 21 nt, synthetic construct
  source 1..21: mol_type = other RNA
gcgtgcttggacacacagatt

SEQ ID NO: 584 - RNA, 21 nt, synthetic construct
  source 1..21: mol_type = other RNA
agagtgaggtgactggcattt

SEQ ID NO: 585 - RNA, 21 nt, synthetic construct
  source 1..21: mol_type = other RNA
cgtgcttggacacacagactt

SEQ ID NO: 586 - RNA, 21 nt, synthetic construct
  source 1..21: mol_type = other RNA
gtgcttggacacacagacatt

SEQ ID NO: 587 - RNA, 21 nt, synthetic construct
  source 1..21: mol_type = other RNA
tgcttggacacacagacactt

SEQ ID NO: 588 - RNA, 21 nt, synthetic construct
  source 1..21: mol_type = other RNA
gcttggacacacagacacgtt

SEQ ID NO: 589 - RNA, 21 nt, synthetic construct
  source 1..21: mol_type = other RNA
cttggacacacagacacgctt

SEQ ID NO: 590 - RNA, 21 nt, synthetic construct
  source 1..21: mol_type = other RNA
ttggacacacagacacgcatt

SEQ ID NO: 591 - RNA, 21 nt, synthetic construct
  source 1..21: mol_type = other RNA
tggacacacagacacgcagtt

SEQ ID NO: 592 - RNA, 21 nt, synthetic construct
  source 1..21: mol_type = other RNA
ggacacacagacacgcagatt

SEQ ID NO: 593 - RNA, 21 nt, synthetic construct
  source 1..21: mol_type = other RNA
gacacacagacacgcagactt

SEQ ID NO: 594 - RNA, 21 nt, synthetic construct
  source 1..21: mol_type = other RNA
acacacagacacgcagacatt

SEQ ID NO: 595 - RNA, 21 nt, synthetic construct
  source 1..21: mol_type = other RNA
gagtgaggtgactggcatgtt

SEQ ID NO: 596 - RNA, 21 nt, synthetic construct
  source 1..21: mol_type = other RNA
cacacagacacgcagacactt

SEQ ID NO: 597 - RNA, 21 nt, synthetic construct
  source 1..21: mol_type = other RNA
acacagacacgcagacacatt

SEQ ID NO: 598 - RNA, 21 nt, synthetic construct
  source 1..21: mol_type = other RNA
cacagacacgcagacacagtt

SEQ ID NO: 599 - RNA, 21 nt, synthetic construct
  source 1..21: mol_type = other RNA
acagacacgcagacacagatt

SEQ ID NO: 600 - RNA, 21 nt, synthetic construct
  source 1..21: mol_type = other RNA
cagacacgcagacacagagtt

SEQ ID NO: 601 - RNA, 21 nt, synthetic construct
  source 1..21: mol_type = other RNA
agacacgcagacacagagatt

SEQ ID NO: 602 - RNA, 21 nt, synthetic construct
  source 1..21: mol_type = other RNA
gacacgcagacacagagactt

SEQ ID NO: 603 - RNA, 21 nt, synthetic construct
  source 1..21: mol_type = other RNA
acacgcagacacagagacatt

SEQ ID NO: 604 - RNA, 21 nt, synthetic construct
  source 1..21: mol_type = other RNA
cacgcagacacagagacactt

SEQ ID NO: 605 - RNA, 21 nt, synthetic construct
  source 1..21: mol_type = other RNA
acgcagacacagagacacctt

SEQ ID NO: 606 - RNA, 21 nt, synthetic construct
  source 1..21: mol_type = other RNA
agtgaggtgactggcatgttt

SEQ ID NO: 607 - RNA, 21 nt, synthetic construct
  source 1..21: mol_type = other RNA
cgcagacacagagacaccgtt

SEQ ID NO: 608 - RNA, 21 nt, synthetic construct
  source 1..21: mol_type = other RNA
gcagacacagagacaccggtt

SEQ ID NO: 609 - RNA, 21 nt, synthetic construct
  source 1..21: mol_type = other RNA
cagacacagagacaccgggtt

SEQ ID NO: 610 - RNA, 21 nt, synthetic construct
  source 1..21: mol_type = other RNA
agacacagagacaccggggtt

SEQ ID NO: 611 - RNA, 21 nt, synthetic construct
  source 1..21: mol_type = other RNA
gacacagagacaccggggctt

SEQ ID NO: 612 - RNA, 21 nt, synthetic construct
  source 1..21: mol_type = other RNA
acacagagacaccggggcctt

SEQ ID NO: 613 - RNA, 21 nt, synthetic construct
  source 1..21: mol_type = other RNA
cacagagacaccggggccctt

SEQ ID NO: 614 - RNA, 21 nt, synthetic construct
  source 1..21: mol_type = other RNA
acagagacaccggggcccatt

SEQ ID NO: 615 - RNA, 21 nt, synthetic construct
  source 1..21: mol_type = other RNA
cagagacaccggggcccagtt

SEQ ID NO: 616 - RNA, 21 nt, synthetic construct
  source 1..21: mol_type = other RNA
agagacaccggggcccaggtt

SEQ ID NO: 617 - RNA, 21 nt, synthetic construct
  source 1..21: mol_type = other RNA
gtgaggtgactggcatgtgtt

SEQ ID NO: 618 - RNA, 21 nt, synthetic construct
  source 1..21: mol_type = other RNA
gagacaccggggcccagggtt

SEQ ID NO: 619 - RNA, 21 nt, synthetic construct
  source 1..21: mol_type = other RNA
agacaccggggcccagggctt

SEQ ID NO: 620 - RNA, 21 nt, synthetic construct
  source 1..21: mol_type = other RNA
gacaccggggcccagggcctt

SEQ ID NO: 621 - RNA, 21 nt, synthetic construct
  source 1..21: mol_type = other RNA
acaccggggcccagggccctt

SEQ ID NO: 622 - RNA, 21 nt, synthetic construct
  source 1..21: mol_type = other RNA
caccggggcccagggcccttt

SEQ ID NO: 623 - RNA, 21 nt, synthetic construct
  source 1..21: mol_type = other RNA
accggggcccagggccctctt

SEQ ID NO: 624 - RNA, 21 nt, synthetic construct
  source 1..21: mol_type = other RNA
ccaaacggtgcacggaagatt

SEQ ID NO: 625 - RNA, 21 nt, synthetic construct
  source 1..21: mol_type = other RNA
ccggggcccagggccctcctt

SEQ ID NO: 626 - RNA, 21 nt, synthetic construct
  source 1..21: mol_type = other RNA
cggggcccagggccctccttt

SEQ ID NO: 627 - RNA, 21 nt, synthetic construct
  source 1..21: mol_type = other RNA
ggggcccagggccctcctatt

SEQ ID NO: 628 - RNA, 21 nt, synthetic construct
  source 1..21: mol_type = other RNA
gggcccagggccctcctattt

SEQ ID NO: 629 - RNA, 21 nt, synthetic construct
  source 1..21: mol_type = other RNA
tgaggtgactggcatgtgttt

SEQ ID NO: 630 - RNA, 21 nt, synthetic construct
  source 1..21: mol_type = other RNA
ggcccagggccctcctatgtt

SEQ ID NO: 631 - RNA, 21 nt, synthetic construct
  source 1..21: mol_type = other RNA
gcccagggccctcctatggtt

SEQ ID NO: 632 - RNA, 21 nt, synthetic construct
  source 1..21: mol_type = other RNA
cccagggccctcctatggatt

SEQ ID NO: 633 - RNA, 21 nt, synthetic construct
  source 1..21: mol_type = other RNA
ccagggccctcctatggactt

SEQ ID NO: 634 - RNA, 21 nt, synthetic construct
  source 1..21: mol_type = other RNA
cagggccctcctatggacctt

SEQ ID NO: 635 - RNA, 21 nt, synthetic construct
  source 1..21: mol_type = other RNA
agggccctcctatggaccctt

SEQ ID NO: 636 - RNA, 21 nt, synthetic construct
  source 1..21: mol_type = other RNA
gggccctcctatggacccttt

SEQ ID NO: 637 - RNA, 21 nt, synthetic construct
  source 1..21: mol_type = other RNA
ggccctcctatggaccctgtt

SEQ ID NO: 638 - RNA, 21 nt, synthetic construct
  source 1..21: mol_type = other RNA
gccctcctatggaccctgctt

SEQ ID NO: 639 - RNA, 21 nt, synthetic construct
  source 1..21: mol_type = other RNA
ccctcctatggaccctgcctt

SEQ ID NO: 640 - RNA, 21 nt, synthetic construct
  source 1..21: mol_type = other RNA
gaggtgactggcatgtgtgtt

SEQ ID NO: 641 - RNA, 21 nt, synthetic construct
  source 1..21: mol_type = other RNA
cctcctatggaccctgccctt

SEQ ID NO: 642 - RNA, 21 nt, synthetic construct
  source 1..21: mol_type = other RNA
ctcctatggaccctgcccgtt

SEQ ID NO: 643 - RNA, 21 nt, synthetic construct
  source 1..21: mol_type = other RNA
tcctatggaccctgcccgctt

SEQ ID NO: 644 - RNA, 21 nt, synthetic construct
  source 1..21: mol_type = other RNA
cctatggaccctgcccgcttt

SEQ ID NO: 645 - RNA, 21 nt, synthetic construct
  source 1..21: mol_type = other RNA
ctatggaccctgcccgctctt

SEQ ID NO: 646 - RNA, 21 nt, synthetic construct
  source 1..21: mol_type = other RNA
tatggaccctgcccgctcctt

SEQ ID NO: 647 - RNA, 21 nt, synthetic construct
  source 1..21: mol_type = other RNA
atggaccctgcccgctccctt

SEQ ID NO: 648 - RNA, 21 nt, synthetic construct
  source 1..21: mol_type = other RNA
tggaccctgcccgctcccctt

SEQ ID NO: 649 - RNA, 21 nt, synthetic construct
  source 1..21: mol_type = other RNA
ggaccctgcccgctccccttt

SEQ ID NO: 650 - RNA, 21 nt, synthetic construct
  source 1..21: mol_type = other RNA
gaccctgcccgctcccctctt

SEQ ID NO: 651 - RNA, 21 nt, synthetic construct
  source 1..21: mol_type = other RNA
aggtgactggcatgtgtggtt

SEQ ID NO: 652 - RNA, 21 nt, synthetic construct
  source 1..21: mol_type = other RNA
accctgcccgctcccctcctt

SEQ ID NO: 653 - RNA, 21 nt, synthetic construct
  source 1..21: mol_type = other RNA
ccctgcccgctcccctccctt

SEQ ID NO: 654 - RNA, 21 nt, synthetic construct
  source 1..21: mol_type = other RNA
cctgcccgctcccctcccatt

SEQ ID NO: 655 - RNA, 21 nt, synthetic construct
  source 1..21: mol_type = other RNA
ctgcccgctcccctcccattt

SEQ ID NO: 656 - RNA, 21 nt, synthetic construct
  source 1..21: mol_type = other RNA
tgcccgctcccctcccatttt

SEQ ID NO: 657 - RNA, 21 nt, synthetic construct
  source 1..21: mol_type = other RNA
gcccgctcccctcccattgtt

SEQ ID NO: 658 - RNA, 21 nt, synthetic construct
  source 1..21: mol_type = other RNA
cccgctcccctcccattgttt

SEQ ID NO: 659 - RNA, 21 nt, synthetic construct
  source 1..21: mol_type = other RNA
ccgctcccctcccattgtctt

SEQ ID NO: 660 - RNA, 21 nt, synthetic construct
  source 1..21: mol_type = other RNA
cgctcccctcccattgtcctt

SEQ ID NO: 661 - RNA, 21 nt, synthetic construct
  source 1..21: mol_type = other RNA
gctcccctcccattgtccatt

SEQ ID NO: 662 - RNA, 21 nt, synthetic construct
  source 1..21: mol_type = other RNA
ctcccctcccattgtccactt

SEQ ID NO: 663 - RNA, 21 nt, synthetic construct
  source 1..21: mol_type = other RNA
ggtgactggcatgtgtgggtt

SEQ ID NO: 664 - RNA, 21 nt, synthetic construct
  source 1..21: mol_type = other RNA
tcccctcccattgtccacgtt

SEQ ID NO: 665 - RNA, 21 nt, synthetic construct
  source 1..21: mol_type = other RNA
cccctcccattgtccacggtt

SEQ ID NO: 666 - RNA, 21 nt, synthetic construct
  source 1..21: mol_type = other RNA
ccctcccattgtccacggctt

SEQ ID NO: 667 - RNA, 21 nt, synthetic construct
  source 1..21: mol_type = other RNA
cctcccattgtccacggcttt

SEQ ID NO: 668 - RNA, 21 nt, synthetic construct
  source 1..21: mol_type = other RNA
ctcccattgtccacggctgtt

SEQ ID NO: 669 - RNA, 21 nt, synthetic construct
  source 1..21: mol_type = other RNA
tcccattgtccacggctgttt

SEQ ID NO: 670 - RNA, 21 nt, synthetic construct
  source 1..21: mol_type = other RNA
cccattgtccacggctgtctt

SEQ ID NO: 671 - RNA, 21 nt, synthetic construct
  source 1..21: mol_type = other RNA
ccattgtccacggctgtcctt

SEQ ID NO: 672 - RNA, 21 nt, synthetic construct
  source 1..21: mol_type = other RNA
cattgtccacggctgtccgtt

SEQ ID NO: 673 - RNA, 21 nt, synthetic construct
  source 1..21: mol_type = other RNA
attgtccacggctgtccgctt

SEQ ID NO: 674 - RNA, 21 nt, synthetic construct
  source 1..21: mol_type = other RNA
gtgactggcatgtgtggggtt

SEQ ID NO: 675 - RNA, 21 nt, synthetic construct
  source 1..21: mol_type = other RNA
ttgtccacggctgtccgcctt

SEQ ID NO: 676 - RNA, 21 nt, synthetic construct
  source 1..21: mol_type = other RNA
tgtccacggctgtccgccctt

SEQ ID NO: 677 - RNA, 21 nt, synthetic construct
  source 1..21: mol_type = other RNA
gtccacggctgtccgcccatt

SEQ ID NO: 678 - RNA, 21 nt, synthetic construct
  source 1..21: mol_type = other RNA
tccacggctgtccgcccactt

SEQ ID NO: 679 - RNA, 21 nt, synthetic construct
  source 1..21: mol_type = other RNA
ccacggctgtccgcccacctt

SEQ ID NO: 680 - RNA, 21 nt, synthetic construct
  source 1..21: mol_type = other RNA
cacggctgtccgcccaccctt

SEQ ID NO: 681 - RNA, 21 nt, synthetic construct
  source 1..21: mol_type = other RNA
acggctgtccgcccacccctt

SEQ ID NO: 682 - RNA, 21 nt, synthetic construct
  source 1..21: mol_type = other RNA
cggctgtccgcccaccccctt

SEQ ID NO: 683 - RNA, 21 nt, synthetic construct
  source 1..21: mol_type = other RNA
ggctgtccgcccacccccatt

SEQ ID NO: 684 - RNA, 21 nt, synthetic construct
  source 1..21: mol_type = other RNA
gctgtccgcccacccccattt

SEQ ID NO: 685 - RNA, 21 nt, synthetic construct
  source 1..21: mol_type = other RNA
tgactggcatgtgtgggggtt

SEQ ID NO: 686 - RNA, 21 nt, synthetic construct
  source 1..21: mol_type = other RNA
ctgtccgcccacccccatttt

SEQ ID NO: 687 - RNA, 21 nt, synthetic construct
  source 1..21: mol_type = other RNA
tgtccgcccacccccattctt

SEQ ID NO: 688 - RNA, 21 nt, synthetic construct
  source 1..21: mol_type = other RNA
gtccgcccacccccattcttt

SEQ ID NO: 689 - RNA, 21 nt, synthetic construct
  source 1..21: mol_type = other RNA
tccgcccacccccattctctt

SEQ ID NO: 690 - RNA, 21 nt, synthetic construct
  source 1..21: mol_type = other RNA
ccgcccacccccattctcctt

SEQ ID NO: 691 - RNA, 21 nt, synthetic construct
  source 1..21: mol_type = other RNA
cgcccacccccattctccatt

SEQ ID NO: 692 - RNA, 21 nt, synthetic construct
  source 1..21: mol_type = other RNA
gcccacccccattctccaatt

SEQ ID NO: 693 - RNA, 21 nt, synthetic construct
  source 1..21: mol_type = other RNA
cccacccccattctccaagtt

SEQ ID NO: 694 - RNA, 21 nt, synthetic construct
  source 1..21: mol_type = other RNA
ccacccccattctccaagctt

SEQ ID NO: 695 - RNA, 21 nt, synthetic construct
  source 1..21: mol_type = other RNA
cacccccattctccaagcttt

SEQ ID NO: 696 - RNA, 21 nt, synthetic construct
  source 1..21: mol_type = other RNA
gactggcatgtgtgggggctt

SEQ ID NO: 697 - RNA, 21 nt, synthetic construct
  source 1..21: mol_type = other RNA
acccccattctccaagctttt

SEQ ID NO: 698 - RNA, 21 nt, synthetic construct
  source 1..21: mol_type = other RNA
cccccattctccaagcttctt

SEQ ID NO: 699 - RNA, 21 nt, synthetic construct
  source 1..21: mol_type = other RNA
ccccattctccaagcttcatt

SEQ ID NO: 700 - RNA, 21 nt, synthetic construct
  source 1..21: mol_type = other RNA
cccattctccaagcttcagtt

SEQ ID NO: 701 - RNA, 21 nt, synthetic construct
  source 1..21: mol_type = other RNA
ccattctccaagcttcagctt

SEQ ID NO: 702 - RNA, 21 nt, synthetic construct
  source 1..21: mol_type = other RNA
cattctccaagcttcagcctt

SEQ ID NO: 703 - RNA, 21 nt, synthetic construct
  source 1..21: mol_type = other RNA
attctccaagcttcagccctt

SEQ ID NO: 704 - RNA, 21 nt, synthetic construct
  source 1..21: mol_type = other RNA
ttctccaagcttcagcccctt

SEQ ID NO: 705 - RNA, 21 nt, synthetic construct
  source 1..21: mol_type = other RNA
tctccaagcttcagccccctt

SEQ ID NO: 706 - RNA, 21 nt, synthetic construct
  source 1..21: mol_type = other RNA
ctccaagcttcagcccccttt

SEQ ID NO: 707 - RNA, 21 nt, synthetic construct
  source 1..21: mol_type = other RNA
actggcatgtgtgggggcatt

SEQ ID NO: 708 - RNA, 21 nt, synthetic construct
  source 1..21: mol_type = other RNA
tccaagcttcagccccctctt

SEQ ID NO: 709 - RNA, 21 nt, synthetic construct
  source 1..21: mol_type = other RNA
ccaagcttcagccccctcctt

SEQ ID NO: 710 - RNA, 21 nt, synthetic construct
  source 1..21: mol_type = other RNA
caagcttcagccccctccttt

SEQ ID NO: 711 - RNA, 21 nt, synthetic construct
  source 1..21: mol_type = other RNA
aagcttcagccccctcctttt

SEQ ID NO: 712 - RNA, 21 nt, synthetic construct
  source 1..21: mol_type = other RNA
agcttcagccccctccttatt

SEQ ID NO: 713 - RNA, 21 nt, synthetic construct
  source 1..21: mol_type = other RNA
gcttcagccccctccttagtt

SEQ ID NO: 714 - RNA, 21 nt, synthetic construct
  source 1..21: mol_type = other RNA
cttcagccccctccttagttt

SEQ ID NO: 715 - RNA, 21 nt, synthetic construct
  source 1..21: mol_type = other RNA
ttcagccccctccttagtttt

SEQ ID NO: 716 - RNA, 21 nt, synthetic construct
  source 1..21: mol_type = other RNA
tcagccccctccttagttctt

SEQ ID NO: 717 - RNA, 21 nt, synthetic construct
  source 1..21: mol_type = other RNA
cagccccctccttagttcgtt

SEQ ID NO: 718 - RNA, 21 nt, synthetic construct
  source 1..21: mol_type = other RNA
ctggcatgtgtgggggcaatt

SEQ ID NO: 719 - RNA, 21 nt, synthetic construct
  source 1..21: mol_type = other RNA
agccccctccttagttcggtt

SEQ ID NO: 720 - RNA, 21 nt, synthetic construct
  source 1..21: mol_type = other RNA
gccccctccttagttcggctt

SEQ ID NO: 721 - RNA, 21 nt, synthetic construct
  source 1..21: mol_type = other RNA
ccccctccttagttcggcatt

SEQ ID NO: 722 - RNA, 21 nt, synthetic construct
  source 1..21: mol_type = other RNA
cccctccttagttcggcattt

SEQ ID NO: 723 - RNA, 21 nt, synthetic construct
  source 1..21: mol_type = other RNA
ccctccttagttcggcatctt

SEQ ID NO: 724 - RNA, 21 nt, synthetic construct
  source 1..21: mol_type = other RNA
cctccttagttcggcatcttt

SEQ ID NO: 725 - RNA, 21 nt, synthetic construct
  source 1..21: mol_type = other RNA
ctccttagttcggcatctgtt

SEQ ID NO: 726 - RNA, 21 nt, synthetic construct
  source 1..21: mol_type = other RNA
tccttagttcggcatctgctt

SEQ ID NO: 727 - RNA, 21 nt, synthetic construct
  source 1..21: mol_type = other RNA
ccttagttcggcatctgcatt

SEQ ID NO: 728 - RNA, 21 nt, synthetic construct
  source 1..21: mol_type = other RNA
cttagttcggcatctgcactt

SEQ ID NO: 729 - RNA, 21 nt, synthetic construct
  source 1..21: mol_type = other RNA
tggcatgtgtgggggcaactt

SEQ ID NO: 730 - RNA, 21 nt, synthetic construct
  source 1..21: mol_type = other RNA
ttagttcggcatctgcacatt

SEQ ID NO: 731 - RNA, 21 nt, synthetic construct
  source 1..21: mol_type = other RNA
tagttcggcatctgcacagtt

SEQ ID NO: 732 - RNA, 21 nt, synthetic construct
  source 1..21: mol_type = other RNA
agttcggcatctgcacagctt

SEQ ID NO: 733 - RNA, 21 nt, synthetic construct
  source 1..21: mol_type = other RNA
gttcggcatctgcacagcatt

SEQ ID NO: 734 - RNA, 21 nt, synthetic construct
  source 1..21: mol_type = other RNA
ttcggcatctgcacagcactt

SEQ ID NO: 735 - RNA, 21 nt, synthetic construct
  source 1..21: mol_type = other RNA
tcggcatctgcacagcacttt

SEQ ID NO: 736 - RNA, 21 nt, synthetic construct
  source 1..21: mol_type = other RNA
caaacggtgcacggaagagtt

SEQ ID NO: 737 - RNA, 21 nt, synthetic construct
  source 1..21: mol_type = other RNA
cggcatctgcacagcactgtt

SEQ ID NO: 738 - RNA, 21 nt, synthetic construct
  source 1..21: mol_type = other RNA
ggcatctgcacagcactgatt

SEQ ID NO: 739 - RNA, 21 nt, synthetic construct
  source 1..21: mol_type = other RNA
gcatctgcacagcactgaatt

SEQ ID NO: 740 - RNA, 21 nt, synthetic construct
  source 1..21: mol_type = other RNA
catctgcacagcactgaagtt

SEQ ID NO: 741 - RNA, 21 nt, synthetic construct
  source 1..21: mol_type = other RNA
ggcatgtgtgggggcaacatt

SEQ ID NO: 742 - RNA, 21 nt, synthetic construct
  source 1..21: mol_type = other RNA
atctgcacagcactgaagatt

SEQ ID NO: 743 - RNA, 21 nt, synthetic construct
  source 1..21: mol_type = other RNA
tctgcacagcactgaagaatt

SEQ ID NO: 744 - RNA, 21 nt, synthetic construct
  source 1..21: mol_type = other RNA
ctgcacagcactgaagaactt

SEQ ID NO: 745 - RNA, 21 nt, synthetic construct
  source 1..21: mol_type = other RNA
tgcacagcactgaagaacctt

SEQ ID NO: 746 - RNA, 21 nt, synthetic construct
  source 1..21: mol_type = other RNA
gcacagcactgaagaaccttt

SEQ ID NO: 747 - RNA, 21 nt, synthetic construct
  source 1..21: mol_type = other RNA
cacagcactgaagaacctgtt

SEQ ID NO: 748 - RNA, 21 nt, synthetic construct
  source 1..21: mol_type = other RNA
acagcactgaagaacctggtt

SEQ ID NO: 749 - RNA, 21 nt, synthetic construct
  source 1..21: mol_type = other RNA
cagcactgaagaacctgggtt

SEQ ID NO: 750 - RNA, 21 nt, synthetic construct
  source 1..21: mol_type = other RNA
agcactgaagaacctgggatt

SEQ ID NO: 751 - RNA, 21 nt, synthetic construct
  source 1..21: mol_type = other RNA
gcactgaagaacctgggaatt

SEQ ID NO: 752 - RNA, 21 nt, synthetic construct
  source 1..21: mol_type = other RNA
gcatgtgtgggggcaacactt

SEQ ID NO: 753 - RNA, 21 nt, synthetic construct
  source 1..21: mol_type = other RNA
cactgaagaacctgggaattt

SEQ ID NO: 754 - RNA, 21 nt, synthetic construct
  source 1..21: mol_type = other RNA
actgaagaacctgggaatctt

SEQ ID NO: 755 - RNA, 21 nt, synthetic construct
  source 1..21: mol_type = other RNA
ctgaagaacctgggaatcatt

SEQ ID NO: 756 - RNA, 21 nt, synthetic construct
  source 1..21: mol_type = other RNA
tgaagaacctgggaatcagtt

SEQ ID NO: 757 - RNA, 21 nt, synthetic construct
  source 1..21: mol_type = other RNA
gaagaacctgggaatcagatt

SEQ ID NO: 758 - RNA, 21 nt, synthetic construct
  source 1..21: mol_type = other RNA
aagaacctgggaatcagactt

SEQ ID NO: 759 - RNA, 21 nt, synthetic construct
  source 1..21: mol_type = other RNA
agaacctgggaatcagacctt

SEQ ID NO: 760 - RNA, 21 nt, synthetic construct
  source 1..21: mol_type = other RNA
gaacctgggaatcagaccctt

SEQ ID NO: 761 - RNA, 21 nt, synthetic construct
  source 1..21: mol_type = other RNA
aacctgggaatcagacccttt

SEQ ID NO: 762 - RNA, 21 nt, synthetic construct
  source 1..21: mol_type = other RNA
acctgggaatcagaccctgtt

SEQ ID NO: 763 - RNA, 21 nt, synthetic construct
  source 1..21: mol_type = other RNA
catgtgtgggggcaacacgtt

SEQ ID NO: 764 - RNA, 21 nt, synthetic construct
  source 1..21: mol_type = other RNA
cctgggaatcagaccctgatt

SEQ ID NO: 765 - RNA, 21 nt, synthetic construct
  source 1..21: mol_type = other RNA
ctgggaatcagaccctgagtt

SEQ ID NO: 766 - RNA, 21 nt, synthetic construct
  source 1..21: mol_type = other RNA
tgggaatcagaccctgagatt

SEQ ID NO: 767 - RNA, 21 nt, synthetic construct
  source 1..21: mol_type = other RNA
gggaatcagaccctgagactt

SEQ ID NO: 768 - RNA, 21 nt, synthetic construct
  source 1..21: mol_type = other RNA
ggaatcagaccctgagacctt

SEQ ID NO: 769 - RNA, 21 nt, synthetic construct
  source 1..21: mol_type = other RNA
gaatcagaccctgagaccctt

SEQ ID NO: 770 - RNA, 21 nt, synthetic construct
  source 1..21: mol_type = other RNA
aatcagaccctgagacccttt

SEQ ID NO: 771 - RNA, 21 nt, synthetic construct
  source 1..21: mol_type = other RNA
atcagaccctgagaccctgtt

SEQ ID NO: 772 - RNA, 21 nt, synthetic construct
  source 1..21: mol_type = other RNA
tcagaccctgagaccctgatt

SEQ ID NO: 773 - RNA, 21 nt, synthetic construct
  source 1..21: mol_type = other RNA
cagaccctgagaccctgagtt

SEQ ID NO: 774 - RNA, 21 nt, synthetic construct
  source 1..21: mol_type = other RNA
atgtgtgggggcaacacgatt

SEQ ID NO: 775 - RNA, 21 nt, synthetic construct
  source 1..21: mol_type = other RNA
agaccctgagaccctgagctt

SEQ ID NO: 776 - RNA, 21 nt, synthetic construct
  source 1..21: mol_type = other RNA
gaccctgagaccctgagcatt

SEQ ID NO: 777 - RNA, 21 nt, synthetic construct
  source 1..21: mol_type = other RNA
accctgagaccctgagcaatt

SEQ ID NO: 778 - RNA, 21 nt, synthetic construct
  source 1..21: mol_type = other RNA
ccctgagaccctgagcaattt

SEQ ID NO: 779 - RNA, 21 nt, synthetic construct
  source 1..21: mol_type = other RNA
cctgagaccctgagcaatctt

SEQ ID NO: 780 - RNA, 21 nt, synthetic construct
  source 1..21: mol_type = other RNA
ctgagaccctgagcaatcctt

SEQ ID NO: 781 - RNA, 21 nt, synthetic construct
  source 1..21: mol_type = other RNA
tgagaccctgagcaatccctt

SEQ ID NO: 782 - RNA, 21 nt, synthetic construct
  source 1..21: mol_type = other RNA
gagaccctgagcaatcccatt

SEQ ID NO: 783 - RNA, 21 nt, synthetic construct
  source 1..21: mol_type = other RNA
agaccctgagcaatcccagtt

SEQ ID NO: 784 - RNA, 21 nt, synthetic construct
  source 1..21: mol_type = other RNA
gaccctgagcaatcccaggtt

SEQ ID NO: 785 - RNA, 21 nt, synthetic construct
  source 1..21: mol_type = other RNA
accctgagcaatcccaggttt

SEQ ID NO: 786 - RNA, 21 nt, synthetic construct
  source 1..21: mol_type = other RNA
tgtgtgggggcaacacgattt

SEQ ID NO: 787 - RNA, 21 nt, synthetic construct
  source 1..21: mol_type = other RNA
ccctgagcaatcccaggtctt

SEQ ID NO: 788 - RNA, 21 nt, synthetic construct
  source 1..21: mol_type = other RNA
cctgagcaatcccaggtcctt

SEQ ID NO: 789 - RNA, 21 nt, synthetic construct
  source 1..21: mol_type = other RNA
ctgagcaatcccaggtccatt

SEQ ID NO: 790 - RNA, 21 nt, synthetic construct
  source 1..21: mol_type = other RNA
tgagcaatcccaggtccagtt

SEQ ID NO: 791 - RNA, 21 nt, synthetic construct
  source 1..21: mol_type = other RNA
gagcaatcccaggtccagctt

SEQ ID NO: 792 - RNA, 21 nt, synthetic construct
  source 1..21: mol_type = other RNA
agcaatcccaggtccagcgtt

SEQ ID NO: 793 - RNA, 21 nt, synthetic construct
  source 1..21: mol_type = other RNA
gcaatcccaggtccagcgctt

SEQ ID NO: 794 - RNA, 21 nt, synthetic construct
  source 1..21: mol_type = other RNA
caatcccaggtccagcgcctt

SEQ ID NO: 795 - RNA, 21 nt, synthetic construct
  source 1..21: mol_type = other RNA
aatcccaggtccagcgccatt

SEQ ID NO: 796 - RNA, 21 nt, synthetic construct
  source 1..21: mol_type = other RNA
atcccaggtccagcgccagtt

SEQ ID NO: 797 - RNA, 21 nt, synthetic construct
  source 1..21: mol_type = other RNA
gtgtgggggcaacacgatttt

SEQ ID NO: 798 - RNA, 21 nt, synthetic construct
  source 1..21: mol_type = other RNA
tcccaggtccagcgccagctt

SEQ ID NO: 799 - RNA, 21 nt, synthetic construct
  source 1..21: mol_type = other RNA
cccaggtccagcgccagcctt

SEQ ID NO: 800 - RNA, 21 nt, synthetic construct
  source 1..21: mol_type = other RNA
ccaggtccagcgccagccctt

SEQ ID NO: 801 - RNA, 21 nt, synthetic construct
  source 1..21: mol_type = other RNA
caggtccagcgccagcccttt

SEQ ID NO: 802 - RNA, 21 nt, synthetic construct
  source 1..21: mol_type = other RNA
aggtccagcgccagccctatt

SEQ ID NO: 803 - RNA, 21 nt, synthetic construct
  source 1..21: mol_type = other RNA
ggtccagcgccagccctattt

SEQ ID NO: 804 - RNA, 21 nt, synthetic construct
  source 1..21: mol_type = other RNA
gtccagcgccagccctatctt

SEQ ID NO: 805 - RNA, 21 nt, synthetic construct
  source 1..21: mol_type = other RNA
tccagcgccagccctatcatt

SEQ ID NO: 806 - RNA, 21 nt, synthetic construct
  source 1..21: mol_type = other RNA
ccagcgccagccctatcattt

SEQ ID NO: 807 - RNA, 21 nt, synthetic construct
  source 1..21: mol_type = other RNA
cagcgccagccctatcatgtt

SEQ ID NO: 808 - RNA, 21 nt, synthetic construct
  source 1..21: mol_type = other RNA
tgtgggggcaacacgattctt

SEQ ID NO: 809 - RNA, 21 nt, synthetic construct
  source 1..21: mol_type = other RNA
agcgccagccctatcatgatt

SEQ ID NO: 810 - RNA, 21 nt, synthetic construct
  source 1..21: mol_type = other RNA
gcgccagccctatcatgactt

SEQ ID NO: 811 - RNA, 21 nt, synthetic construct
  source 1..21: mol_type = other RNA
cgccagccctatcatgacctt

SEQ ID NO: 812 - RNA, 21 nt, synthetic construct
  source 1..21: mol_type = other RNA
gccagccctatcatgaccatt

SEQ ID NO: 813 - RNA, 21 nt, synthetic construct
  source 1..21: mol_type = other RNA
ccagccctatcatgaccaatt

SEQ ID NO: 814 - RNA, 21 nt, synthetic construct
  source 1..21: mol_type = other RNA
cagccctatcatgaccaagtt

SEQ ID NO: 815 - RNA, 21 nt, synthetic construct
  source 1..21: mol_type = other RNA
agccctatcatgaccaaggtt

SEQ ID NO: 816 - RNA, 21 nt, synthetic construct
  source 1..21: mol_type = other RNA
gccctatcatgaccaaggatt

SEQ ID NO: 817 - RNA, 21 nt, synthetic construct
  source 1..21: mol_type = other RNA
ccctatcatgaccaaggagtt

SEQ ID NO: 818 - RNA, 21 nt, synthetic construct
  source 1..21: mol_type = other RNA
cctatcatgaccaaggagttt

SEQ ID NO: 819 - RNA, 21 nt, synthetic construct
  source 1..21: mol_type = other RNA
gtgggggcaacacgattcttt

SEQ ID NO: 820 - RNA, 21 nt, synthetic construct
  source 1..21: mol_type = other RNA
ctatcatgaccaaggagtatt

SEQ ID NO: 821 - RNA, 21 nt, synthetic construct
  source 1..21: mol_type = other RNA
tatcatgaccaaggagtattt

SEQ ID NO: 822 - RNA, 21 nt, synthetic construct
  source 1..21: mol_type = other RNA
atcatgaccaaggagtatctt

SEQ ID NO: 823 - RNA, 21 nt, synthetic construct
  source 1..21: mol_type = other RNA
tcatgaccaaggagtatcatt

SEQ ID NO: 824 - RNA, 21 nt, synthetic construct
  source 1..21: mol_type = other RNA
catgaccaaggagtatcaatt

SEQ ID NO: 825 - RNA, 21 nt, synthetic construct
  source 1..21: mol_type = other RNA
atgaccaaggagtatcaagtt

SEQ ID NO: 826 - RNA, 21 nt, synthetic construct
  source 1..21: mol_type = other RNA
tgaccaaggagtatcaagatt

SEQ ID NO: 827 - RNA, 21 nt, synthetic construct
  source 1..21: mol_type = other RNA
gaccaaggagtatcaagactt

SEQ ID NO: 828 - RNA, 21 nt, synthetic construct
  source 1..21: mol_type = other RNA
accaaggagtatcaagacctt

SEQ ID NO: 829 - RNA, 21 nt, synthetic construct
  source 1..21: mol_type = other RNA
ccaaggagtatcaagaccttt

SEQ ID NO: 830 - RNA, 21 nt, synthetic construct
  source 1..21: mol_type = other RNA
tgggggcaacacgattctctt

SEQ ID NO: 831 - RNA, 21 nt, synthetic construct
  source 1..21: mol_type = other RNA
caaggagtatcaagacctttt

SEQ ID NO: 832 - RNA, 21 nt, synthetic construct
  source 1..21: mol_type = other RNA
aaggagtatcaagaccttctt

SEQ ID NO: 833 - RNA, 21 nt, synthetic construct
  source 1..21: mol_type = other RNA
aggagtatcaagaccttcatt

SEQ ID NO: 834 - RNA, 21 nt, synthetic construct
  source 1..21: mol_type = other RNA
ggagtatcaagaccttcagtt

SEQ ID NO: 835 - RNA, 21 nt, synthetic construct
  source 1..21: mol_type = other RNA
gagtatcaagaccttcagctt

SEQ ID NO: 836 - RNA, 21 nt, synthetic construct
  source 1..21: mol_type = other RNA
agtatcaagaccttcagcatt

SEQ ID NO: 837 - RNA, 21 nt, synthetic construct
  source 1..21: mol_type = other RNA
gtatcaagaccttcagcattt

SEQ ID NO: 838 - RNA, 21 nt, synthetic construct
  source 1..21: mol_type = other RNA
tatcaagaccttcagcatctt

SEQ ID NO: 839 - RNA, 21 nt, synthetic construct
  source 1..21: mol_type = other RNA
atcaagaccttcagcatcttt

SEQ ID NO: 840 - RNA, 21 nt, synthetic construct
  source 1..21: mol_type = other RNA
tcaagaccttcagcatctgtt

SEQ ID NO: 841 - RNA, 21 nt, synthetic construct
  source 1..21: mol_type = other RNA
gggggcaacacgattctcctt

SEQ ID NO: 842 - RNA, 21 nt, synthetic construct
  source 1..21: mol_type = other RNA
caagaccttcagcatctggtt

SEQ ID NO: 843 - RNA, 21 nt, synthetic construct
  source 1..21: mol_type = other RNA
aagaccttcagcatctggatt

SEQ ID NO: 844 - RNA, 21 nt, synthetic construct
  source 1..21: mol_type = other RNA
agaccttcagcatctggactt

SEQ ID NO: 845 - RNA, 21 nt, synthetic construct
  source 1..21: mol_type = other RNA
gaccttcagcatctggacatt

SEQ ID NO: 846 - RNA, 21 nt, synthetic construct
  source 1..21: mol_type = other RNA
accttcagcatctggacaatt

SEQ ID NO: 847 - RNA, 21 nt, synthetic construct
  source 1..21: mol_type = other RNA
ccttcagcatctggacaattt

SEQ ID NO: 848 - RNA, 21 nt, synthetic construct
  source 1..21: mol_type = other RNA
aaacggtgcacggaagagttt

SEQ ID NO: 849 - RNA, 21 nt, synthetic construct
  source 1..21: mol_type = other RNA
cttcagcatctggacaatgtt

SEQ ID NO: 850 - RNA, 21 nt, synthetic construct
  source 1..21: mol_type = other RNA
ttcagcatctggacaatgatt

SEQ ID NO: 851 - RNA, 21 nt, synthetic construct
  source 1..21: mol_type = other RNA
tcagcatctggacaatgagtt

SEQ ID NO: 852 - RNA, 21 nt, synthetic construct
  source 1..21: mol_type = other RNA
cagcatctggacaatgaggtt

SEQ ID NO: 853 - RNA, 21 nt, synthetic construct
  source 1..21: mol_type = other RNA
ggggcaacacgattctccttt

SEQ ID NO: 854 - RNA, 21 nt, synthetic construct
  source 1..21: mol_type = other RNA
agcatctggacaatgaggatt

SEQ ID NO: 855 - RNA, 21 nt, synthetic construct
  source 1..21: mol_type = other RNA
gcatctggacaatgaggagtt

SEQ ID NO: 856 - RNA, 21 nt, synthetic construct
  source 1..21: mol_type = other RNA
catctggacaatgaggagatt

SEQ ID NO: 857 - RNA, 21 nt, synthetic construct
  source 1..21: mol_type = other RNA
atctggacaatgaggagagtt

SEQ ID NO: 858 - RNA, 21 nt, synthetic construct
  source 1..21: mol_type = other RNA
tctggacaatgaggagagttt

SEQ ID NO: 859 - RNA, 21 nt, synthetic construct
  source 1..21: mol_type = other RNA
ctggacaatgaggagagtgtt

SEQ ID NO: 860 - RNA, 21 nt, synthetic construct
  source 1..21: mol_type = other RNA
tggacaatgaggagagtgatt

SEQ ID NO: 861 - RNA, 21 nt, synthetic construct
  source 1..21: mol_type = other RNA
ggacaatgaggagagtgactt

SEQ ID NO: 862 - RNA, 21 nt, synthetic construct
  source 1..21: mol_type = other RNA
gacaatgaggagagtgacctt

SEQ ID NO: 863 - RNA, 21 nt, synthetic construct
  source 1..21: mol_type = other RNA
acaatgaggagagtgaccatt

SEQ ID NO: 864 - RNA, 21 nt, synthetic construct
  source 1..21: mol_type = other RNA
gggcaacacgattctcctctt

SEQ ID NO: 865 - RNA, 21 nt, synthetic construct
  source 1..21: mol_type = other RNA
caatgaggagagtgaccactt

SEQ ID NO: 866 - RNA, 21 nt, synthetic construct
  source 1..21: mol_type = other RNA
aatgaggagagtgaccacctt

SEQ ID NO: 867 - RNA, 21 nt, synthetic construct
  source 1..21: mol_type = other RNA
atgaggagagtgaccaccatt

SEQ ID NO: 868 - RNA, 21 nt, synthetic construct
  source 1..21: mol_type = other RNA
tgaggagagtgaccaccattt

SEQ ID NO: 869 - RNA, 21 nt, synthetic construct
  source 1..21: mol_type = other RNA
gaggagagtgaccaccatctt

SEQ ID NO: 870 - RNA, 21 nt, synthetic construct
  source 1..21: mol_type = other RNA
aggagagtgaccaccatcatt

SEQ ID NO: 871 - RNA, 21 nt, synthetic construct
  source 1..21: mol_type = other RNA
ggagagtgaccaccatcagtt

SEQ ID NO: 872 - RNA, 21 nt, synthetic construct
  source 1..21: mol_type = other RNA
gagagtgaccaccatcagctt

SEQ ID NO: 873 - RNA, 21 nt, synthetic construct
  source 1..21: mol_type = other RNA
agagtgaccaccatcagcttt

SEQ ID NO: 874 - RNA, 21 nt, synthetic construct
  source 1..21: mol_type = other RNA
gagtgaccaccatcagctctt

SEQ ID NO: 875 - RNA, 21 nt, synthetic construct
  source 1..21: mol_type = other RNA
ggcaacacgattctcctcctt

SEQ ID NO: 876 - RNA, 21 nt, synthetic construct
  source 1..21: mol_type = other RNA
agtgaccaccatcagctcatt

SEQ ID NO: 877 - RNA, 21 nt, synthetic construct
  source 1..21: mol_type = other RNA
gtgaccaccatcagctcagtt

SEQ ID NO: 878 - RNA, 21 nt, synthetic construct
  source 1..21: mol_type = other RNA
tgaccaccatcagctcagatt

SEQ ID NO: 879 - RNA, 21 nt, synthetic construct
  source 1..21: mol_type = other RNA
gaccaccatcagctcagaatt

SEQ ID NO: 880 - RNA, 21 nt, synthetic construct
  source 1..21: mol_type = other RNA
accaccatcagctcagaaatt

SEQ ID NO: 881 - RNA, 21 nt, synthetic construct
  source 1..21: mol_type = other RNA
ccaccatcagctcagaaaatt

SEQ ID NO: 882 - RNA, 21 nt, synthetic construct
  source 1..21: mol_type = other RNA
caccatcagctcagaaaagtt

SEQ ID NO: 883 - RNA, 21 nt, synthetic construct
  source 1..21: mol_type = other RNA
accatcagctcagaaaaggtt

SEQ ID NO: 884 - RNA, 21 nt, synthetic construct
  source 1..21: mol_type = other RNA
ccatcagctcagaaaagggtt

SEQ ID NO: 885 - RNA, 21 nt, synthetic construct
  source 1..21: mol_type = other RNA
catcagctcagaaaagggctt

SEQ ID NO: 886 - RNA, 21 nt, synthetic construct
  source 1..21: mol_type = other RNA
gcaacacgattctcctccctt

SEQ ID NO: 887 - RNA, 21 nt, synthetic construct
  source 1..21: mol_type = other RNA
atcagctcagaaaagggcctt

SEQ ID NO: 888 - RNA, 21 nt, synthetic construct
  source 1..21: mol_type = other RNA
tcagctcagaaaagggccatt

SEQ ID NO: 889 - RNA, 21 nt, synthetic construct
  source 1..21: mol_type = other RNA
cagctcagaaaagggccactt

SEQ ID NO: 890 - RNA, 21 nt, synthetic construct
  source 1..21: mol_type = other RNA
agctcagaaaagggccacctt

SEQ ID NO: 891 - RNA, 21 nt, synthetic construct
  source 1..21: mol_type = other RNA
gctcagaaaagggccaccttt

SEQ ID NO: 892 - RNA, 21 nt, synthetic construct
  source 1..21: mol_type = other RNA
ctcagaaaagggccacctctt

SEQ ID NO: 893 - RNA, 21 nt, synthetic construct
  source 1..21: mol_type = other RNA
tcagaaaagggccacctcctt

SEQ ID NO: 894 - RNA, 21 nt, synthetic construct
  source 1..21: mol_type = other RNA
cagaaaagggccacctccttt

SEQ ID NO: 895 - RNA, 21 nt, synthetic construct
  source 1..21: mol_type = other RNA
agaaaagggccacctcctctt

SEQ ID NO: 896 - RNA, 21 nt, synthetic construct
  source 1..21: mol_type = other RNA
gaaaagggccacctcctcctt

SEQ ID NO: 897 - RNA, 21 nt, synthetic construct
  source 1..21: mol_type = other RNA
caacacgattctcctcccttt

SEQ ID NO: 898 - RNA, 21 nt, synthetic construct
  source 1..21: mol_type = other RNA
aaaagggccacctcctccctt

SEQ ID NO: 899 - RNA, 21 nt, synthetic construct
  source 1..21: mol_type = other RNA
aaagggccacctcctcccctt

SEQ ID NO: 900 - RNA, 21 nt, synthetic construct
  source 1..21: mol_type = other RNA
aagggccacctcctccccatt

SEQ ID NO: 901 - RNA, 21 nt, synthetic construct
  source 1..21: mol_type = other RNA
agggccacctcctccccagtt

SEQ ID NO: 902 - RNA, 21 nt, synthetic construct
  source 1..21: mol_type = other RNA
gggccacctcctccccagctt

SEQ ID NO: 903 - RNA, 21 nt, synthetic construct
  source 1..21: mol_type = other RNA
ggccacctcctccccagcctt

SEQ ID NO: 904 - RNA, 21 nt, synthetic construct
  source 1..21: mol_type = other RNA
gccacctcctccccagccctt

SEQ ID NO: 905 - RNA, 21 nt, synthetic construct
  source 1..21: mol_type = other RNA
ccacctcctccccagcccctt

SEQ ID NO: 906 - RNA, 21 nt, synthetic construct
  source 1..21: mol_type = other RNA
cacctcctccccagccccttt

SEQ ID NO: 907 - RNA, 21 nt, synthetic construct
  source 1..21: mol_type = other RNA
acctcctccccagcccctctt

SEQ ID NO: 908 - RNA, 21 nt, synthetic construct
  source 1..21: mol_type = other RNA
cctcctccccagcccctcctt

SEQ ID NO: 909 - RNA, 21 nt, synthetic construct
  source 1..21: mol_type = other RNA
aacacgattctcctccctgtt

SEQ ID NO: 910 - RNA, 21 nt, synthetic construct
  source 1..21: mol_type = other RNA
ctcctccccagcccctccttt

SEQ ID NO: 911 - RNA, 21 nt, synthetic construct
  source 1..21: mol_type = other RNA
tcctccccagcccctcctgtt

SEQ ID NO: 912 - RNA, 21 nt, synthetic construct
  source 1..21: mol_type = other RNA
cctccccagcccctcctgctt

SEQ ID NO: 913 - RNA, 21 nt, synthetic construct
  source 1..21: mol_type = other RNA
ctccccagcccctcctgcatt

SEQ ID NO: 914 - RNA, 21 nt, synthetic construct
  source 1..21: mol_type = other RNA
tccccagcccctcctgcagtt

SEQ ID NO: 915 - RNA, 21 nt, synthetic construct
  source 1..21: mol_type = other RNA
ccccagcccctcctgcagctt

SEQ ID NO: 916 - RNA, 21 nt, synthetic construct
  source 1..21: mol_type = other RNA
cccagcccctcctgcagcgtt

SEQ ID NO: 917 - RNA, 21 nt, synthetic construct
  source 1..21: mol_type = other RNA
ccagcccctcctgcagcgttt

SEQ ID NO: 918 - RNA, 21 nt, synthetic construct
  source 1..21: mol_type = other RNA
cagcccctcctgcagcgtctt

SEQ ID NO: 919 - RNA, 21 nt, synthetic construct
  source 1..21: mol_type = other RNA
agcccctcctgcagcgtcttt

SEQ ID NO: 920 - RNA, 21 nt, synthetic construct
  source 1..21: mol_type = other RNA
acacgattctcctccctggtt

SEQ ID NO: 921 - RNA, 21 nt, synthetic construct
  source 1..21: mol_type = other RNA
gcccctcctgcagcgtctctt

SEQ ID NO: 922 - RNA, 21 nt, synthetic construct
  source 1..21: mol_type = other RNA
cccctcctgcagcgtctcttt

SEQ ID NO: 923 - RNA, 21 nt, synthetic construct
  source 1..21: mol_type = other RNA
ccctcctgcagcgtctctgtt

SEQ ID NO: 924 - RNA, 21 nt, synthetic construct
  source 1..21: mol_type = other RNA
cctcctgcagcgtctctgctt

SEQ ID NO: 925 - RNA, 21 nt, synthetic construct
  source 1..21: mol_type = other RNA
ctcctgcagcgtctctgcttt

SEQ ID NO: 926 - RNA, 21 nt, synthetic construct
  source 1..21: mol_type = other RNA
tcctgcagcgtctctgctctt

SEQ ID NO: 927 - RNA, 21 nt, synthetic construct
  source 1..21: mol_type = other RNA
cctgcagcgtctctgctcctt

SEQ ID NO: 928 - RNA, 21 nt, synthetic construct
  source 1..21: mol_type = other RNA
ctgcagcgtctctgctccgtt

SEQ ID NO: 929 - RNA, 21 nt, synthetic construct
  source 1..21: mol_type = other RNA
tgcagcgtctctgctccggtt

SEQ ID NO: 930 - RNA, 21 nt, synthetic construct
  source 1..21: mol_type = other RNA
gcagcgtctctgctccggatt

SEQ ID NO: 931 - RNA, 21 nt, synthetic construct
  source 1..21: mol_type = other RNA
cacgattctcctccctgggtt

SEQ ID NO: 932 - RNA, 21 nt, synthetic construct
  source 1..21: mol_type = other RNA
cagcgtctctgctccggactt

SEQ ID NO: 933 - RNA, 21 nt, synthetic construct
  source 1..21: mol_type = other RNA
agcgtctctgctccggacctt

SEQ ID NO: 934 - RNA, 21 nt, synthetic construct
  source 1..21: mol_type = other RNA
gcgtctctgctccggaccttt

SEQ ID NO: 935 - RNA, 21 nt, synthetic construct
  source 1..21: mol_type = other RNA
cgtctctgctccggacctctt

SEQ ID NO: 936 - RNA, 21 nt, synthetic construct
  source 1..21: mol_type = other RNA
gtctctgctccggacctcgtt

SEQ ID NO: 937 - RNA, 21 nt, synthetic construct
  source 1..21: mol_type = other RNA
tctctgctccggacctcgctt

SEQ ID NO: 938 - RNA, 21 nt, synthetic construct
  source 1..21: mol_type = other RNA
ctctgctccggacctcgcctt

SEQ ID NO: 939 - RNA, 21 nt, synthetic construct
  source 1..21: mol_type = other RNA
tctgctccggacctcgccttt

SEQ ID NO: 940 - RNA, 21 nt, synthetic construct
  source 1..21: mol_type = other RNA
ctgctccggacctcgcctctt

SEQ ID NO: 941 - RNA, 21 nt, synthetic construct
  source 1..21: mol_type = other RNA
tgctccggacctcgcctcctt

SEQ ID NO: 942 - RNA, 21 nt, synthetic construct
  source 1..21: mol_type = other RNA
acgattctcctccctggggtt

SEQ ID NO: 943 - RNA, 21 nt, synthetic construct
  source 1..21: mol_type = other RNA
gctccggacctcgcctccttt

SEQ ID NO: 944 - RNA, 21 nt, synthetic construct
  source 1..21: mol_type = other RNA
ctccggacctcgcctcctctt

SEQ ID NO: 945 - RNA, 21 nt, synthetic construct
  source 1..21: mol_type = other RNA
tccggacctcgcctcctcctt

SEQ ID NO: 946 - RNA, 21 nt, synthetic construct
  source 1..21: mol_type = other RNA
ccggacctcgcctcctccttt

SEQ ID NO: 947 - RNA, 21 nt, synthetic construct
  source 1..21: mol_type = other RNA
cggacctcgcctcctcctgtt

SEQ ID NO: 948 - RNA, 21 nt, synthetic construct
  source 1..21: mol_type = other RNA
ggacctcgcctcctcctgctt

SEQ ID NO: 949 - RNA, 21 nt, synthetic construct
  source 1..21: mol_type = other RNA
gacctcgcctcctcctgcttt

SEQ ID NO: 950 - RNA, 21 nt, synthetic construct
  source 1..21: mol_type = other RNA
acctcgcctcctcctgctctt

SEQ ID NO: 951 - RNA, 21 nt, synthetic construct
  source 1..21: mol_type = other RNA
cctcgcctcctcctgctcttt

SEQ ID NO: 952 - RNA, 21 nt, synthetic construct
  source 1..21: mol_type = other RNA
ctcgcctcctcctgctctctt

SEQ ID NO: 953 - RNA, 21 nt, synthetic construct
  source 1..21: mol_type = other RNA
cgattctcctccctggggatt

SEQ ID NO: 954 - RNA, 21 nt, synthetic construct
  source 1..21: mol_type = other RNA
tcgcctcctcctgctctcctt

SEQ ID NO: 955 - RNA, 21 nt, synthetic construct
  source 1..21: mol_type = other RNA
cgcctcctcctgctctccctt

SEQ ID NO: 956 - RNA, 21 nt, synthetic construct
  source 1..21: mol_type = other RNA
gcctcctcctgctctcccttt

SEQ ID NO: 957 - RNA, 21 nt, synthetic construct
  source 1..21: mol_type = other RNA
cctcctcctgctctccctgtt

SEQ ID NO: 958 - RNA, 21 nt, synthetic construct
  source 1..21: mol_type = other RNA
ctcctcctgctctccctggtt

SEQ ID NO: 959 - RNA, 21 nt, synthetic construct
  source 1..21: mol_type = other RNA
tcctcctgctctccctgggtt

SEQ ID NO: 960 - RNA, 21 nt, synthetic construct
  source 1..21: mol_type = other RNA
aacggtgcacggaagagtgtt

SEQ ID NO: 961 - RNA, 21 nt, synthetic construct
  source 1..21: mol_type = other RNA
cctcctgctctccctgggctt

SEQ ID NO: 962 - RNA, 21 nt, synthetic construct
  source 1..21: mol_type = other RNA
ctcctgctctccctgggcctt

SEQ ID NO: 963 - RNA, 21 nt, synthetic construct
  source 1..21: mol_type = other RNA
tcctgctctccctgggccttt

SEQ ID NO: 964 - RNA, 21 nt, synthetic construct
  source 1..21: mol_type = other RNA
cctgctctccctgggcctctt

SEQ ID NO: 965 - RNA, 21 nt, synthetic construct
  source 1..21: mol_type = other RNA
gattctcctccctggggagtt

SEQ ID NO: 966 - RNA, 21 nt, synthetic construct
  source 1..21: mol_type = other RNA
ctgctctccctgggcctcatt

SEQ ID NO: 967 - RNA, 21 nt, synthetic construct
  source 1..21: mol_type = other RNA
tgctctccctgggcctcagtt

SEQ ID NO: 968 - RNA, 21 nt, synthetic construct
  source 1..21: mol_type = other RNA
gctctccctgggcctcagctt

SEQ ID NO: 969 - RNA, 21 nt, synthetic construct
  source 1..21: mol_type = other RNA
ctctccctgggcctcagcctt

SEQ ID NO: 970 - RNA, 21 nt, synthetic construct
  source 1..21: mol_type = other RNA
tctccctgggcctcagccttt

SEQ ID NO: 971 - RNA, 21 nt, synthetic construct
  source 1..21: mol_type = other RNA
ctccctgggcctcagcctctt

SEQ ID NO: 972 - RNA, 21 nt, synthetic construct
  source 1..21: mol_type = other RNA
tccctgggcctcagcctcctt

SEQ ID NO: 973 - RNA, 21 nt, synthetic construct
  source 1..21: mol_type = other RNA
ccctgggcctcagcctccttt

SEQ ID NO: 974 - RNA, 21 nt, synthetic construct
  source 1..21: mol_type = other RNA
cctgggcctcagcctcctgtt

SEQ ID NO: 975 - RNA, 21 nt, synthetic construct
  source 1..21: mol_type = other RNA
ctgggcctcagcctcctgctt

SEQ ID NO: 976 - RNA, 21 nt, synthetic construct
  source 1..21: mol_type = other RNA
attctcctccctggggagctt

SEQ ID NO: 977 - RNA, 21 nt, synthetic construct
  source 1..21: mol_type = other RNA
tgggcctcagcctcctgcttt

SEQ ID NO: 978 - RNA, 21 nt, synthetic construct
  source 1..21: mol_type = other RNA
gggcctcagcctcctgctgtt

SEQ ID NO: 979 - RNA, 21 nt, synthetic construct
  source 1..21: mol_type = other RNA
ggcctcagcctcctgctgctt

SEQ ID NO: 980 - RNA, 21 nt, synthetic construct
  source 1..21: mol_type = other RNA
gcctcagcctcctgctgcttt

SEQ ID NO: 981 - RNA, 21 nt, synthetic construct
  source 1..21: mol_type = other RNA
cctcagcctcctgctgctttt

SEQ ID NO: 982 - RNA, 21 nt, synthetic construct
  source 1..21: mol_type = other RNA
ctcagcctcctgctgcttgtt

SEQ ID NO: 983 - RNA, 21 nt, synthetic construct
  source 1..21: mol_type = other RNA
tcagcctcctgctgcttgttt

SEQ ID NO: 984 - RNA, 21 nt, synthetic construct
  source 1..21: mol_type = other RNA
cagcctcctgctgcttgtgtt

SEQ ID NO: 985 - RNA, 21 nt, synthetic construct
  source 1..21: mol_type = other RNA
agcctcctgctgcttgtggtt

SEQ ID NO: 986 - RNA, 21 nt, synthetic construct
  source 1..21: mol_type = other RNA
gcctcctgctgcttgtggttt

SEQ ID NO: 987 - RNA, 21 nt, synthetic construct
  source 1..21: mol_type = other RNA
ttctcctccctggggagcatt

SEQ ID NO: 988 - RNA, 21 nt, synthetic construct
  source 1..21: mol_type = other RNA
cctcctgctgcttgtggtttt

SEQ ID NO: 989 - RNA, 21 nt, synthetic construct
  source 1..21: mol_type = other RNA
ctcctgctgcttgtggttgtt

SEQ ID NO: 990 - RNA, 21 nt, synthetic construct
  source 1..21: mol_type = other RNA
tcctgctgcttgtggttgttt

SEQ ID NO: 991 - RNA, 21 nt, synthetic construct
  source 1..21: mol_type = other RNA
cctgctgcttgtggttgtctt

SEQ ID NO: 992 - RNA, 21 nt, synthetic construct
  source 1..21: mol_type = other RNA
ctgctgcttgtggttgtcttt

SEQ ID NO: 993 - RNA, 21 nt, synthetic construct
  source 1..21: mol_type = other RNA
tgctgcttgtggttgtctgtt

SEQ ID NO: 994 - RNA, 21 nt, synthetic construct
  source 1..21: mol_type = other RNA
gctgcttgtggttgtctgttt

SEQ ID NO: 995 - RNA, 21 nt, synthetic construct
  source 1..21: mol_type = other RNA
ctgcttgtggttgtctgtgtt

SEQ ID NO: 996 - RNA, 21 nt, synthetic construct
  source 1..21: mol_type = other RNA
tgcttgtggttgtctgtgttt

SEQ ID NO: 997 - RNA, 21 nt, synthetic construct
  source 1..21: mol_type = other RNA
gcttgtggttgtctgtgtgtt

SEQ ID NO: 998 - RNA, 21 nt, synthetic construct
  source 1..21: mol_type = other RNA
tctcctccctggggagcagtt

SEQ ID NO: 999 - RNA, 21 nt, synthetic construct
  source 1..21: mol_type = other RNA
cttgtggttgtctgtgtgatt

SEQ ID NO: 1000 - RNA, 21 nt, synthetic construct
  source 1..21: mol_type = other RNA
ttgtggttgtctgtgtgattt

SEQ ID NO: 1001 - RNA, 21 nt, synthetic construct
  source 1..21: mol_type = other RNA
tgtggttgtctgtgtgatctt

SEQ ID NO: 1002 - RNA, 21 nt, synthetic construct
  source 1..21: mol_type = other RNA
gtggttgtctgtgtgatcgtt

SEQ ID NO: 1003 - RNA, 21 nt, synthetic construct
  source 1..21: mol_type = other RNA
tggttgtctgtgtgatcggtt

SEQ ID NO: 1004 - RNA, 21 nt, synthetic construct
  source 1..21: mol_type = other RNA
ggttgtctgtgtgatcggatt

SEQ ID NO: 1005 - RNA, 21 nt, synthetic construct
  source 1..21: mol_type = other RNA
gttgtctgtgtgatcggattt

SEQ ID NO: 1006 - RNA, 21 nt, synthetic construct
  source 1..21: mol_type = other RNA
ttgtctgtgtgatcggatctt

SEQ ID NO: 1007 - RNA, 21 nt, synthetic construct
  source 1..21: mol_type = other RNA
tgtctgtgtgatcggatcctt

SEQ ID NO: 1008 - RNA, 21 nt, synthetic construct
  source 1..21: mol_type = other RNA
gtctgtgtgatcggatccctt

SEQ ID NO: 1009 - RNA, 21 nt, synthetic construct
  source 1..21: mol_type = other RNA
ctcctccctggggagcagatt

SEQ ID NO: 1010 - RNA, 21 nt, synthetic construct
  source 1..21: mol_type = other RNA
tctgtgtgatcggatcccatt

SEQ ID NO: 1011 - RNA, 21 nt, synthetic construct
  source 1..21: mol_type = other RNA
ctgtgtgatcggatcccaatt

SEQ ID NO: 1012 - RNA, 21 nt, synthetic construct
  source 1..21: mol_type = other RNA
tgtgtgatcggatcccaaatt

SEQ ID NO: 1013 - RNA, 21 nt, synthetic construct
  source 1..21: mol_type = other RNA
gtgtgatcggatcccaaaatt

SEQ ID NO: 1014 - RNA, 21 nt, synthetic construct
  source 1..21: mol_type = other RNA
tgtgatcggatcccaaaactt

SEQ ID NO: 1015 - RNA, 21 nt, synthetic construct
  source 1..21: mol_type = other RNA
gtgatcggatcccaaaacttt

SEQ ID NO: 1016 - RNA, 21 nt, synthetic construct
  source 1..21: mol_type = other RNA
tgatcggatcccaaaactctt

SEQ ID NO: 1017 - RNA, 21 nt, synthetic construct
  source 1..21: mol_type = other RNA
gatcggatcccaaaactcctt

SEQ ID NO: 1018 - RNA, 21 nt, synthetic construct
  source 1..21: mol_type = other RNA
atcggatcccaaaactccctt

SEQ ID NO: 1019 - RNA, 21 nt, synthetic construct
  source 1..21: mol_type = other RNA
tcggatcccaaaactcccatt

SEQ ID NO: 1020 - RNA, 21 nt, synthetic construct
  source 1..21: mol_type = other RNA
tcctccctggggagcagagtt

SEQ ID NO: 1021 - RNA, 21 nt, synthetic construct
  source 1..21: mol_type = other RNA
cggatcccaaaactcccagtt

SEQ ID NO: 1022 - RNA, 21 nt, synthetic construct
  source 1..21: mol_type = other RNA
ggatcccaaaactcccagctt

SEQ ID NO: 1023 - RNA, 21 nt, synthetic construct
  source 1..21: mol_type = other RNA
gatcccaaaactcccagcttt

SEQ ID NO: 1024 - RNA, 21 nt, synthetic construct
  source 1..21: mol_type = other RNA
atcccaaaactcccagctgtt

SEQ ID NO: 1025 - RNA, 21 nt, synthetic construct
  source 1..21: mol_type = other RNA
tcccaaaactcccagctgctt

SEQ ID NO: 1026 - RNA, 21 nt, synthetic construct
  source 1..21: mol_type = other RNA
cccaaaactcccagctgcatt

SEQ ID NO: 1027 - RNA, 21 nt, synthetic construct
  source 1..21: mol_type = other RNA
ccaaaactcccagctgcagtt

SEQ ID NO: 1028 - RNA, 21 nt, synthetic construct
  source 1..21: mol_type = other RNA
caaaactcccagctgcaggtt

SEQ ID NO: 1029 - RNA, 21 nt, synthetic construct
  source 1..21: mol_type = other RNA
aaaactcccagctgcaggatt

SEQ ID NO: 1030 - RNA, 21 nt, synthetic construct
  source 1..21: mol_type = other RNA
aaactcccagctgcaggagtt

SEQ ID NO: 1031 - RNA, 21 nt, synthetic construct
  source 1..21: mol_type = other RNA
cctccctggggagcagagctt

SEQ ID NO: 1032 - RNA, 21 nt, synthetic construct
  source 1..21: mol_type = other RNA
aactcccagctgcaggaggtt

SEQ ID NO: 1033 - RNA, 21 nt, synthetic construct
  source 1..21: mol_type = other RNA
actcccagctgcaggaggatt

SEQ ID NO: 1034 - RNA, 21 nt, synthetic construct
  source 1..21: mol_type = other RNA
ctcccagctgcaggaggagtt

SEQ ID NO: 1035 - RNA, 21 nt, synthetic construct
  source 1..21: mol_type = other RNA
tcccagctgcaggaggagctt

SEQ ID NO: 1036 - RNA, 21 nt, synthetic construct
  source 1..21: mol_type = other RNA
cccagctgcaggaggagcttt

SEQ ID NO: 1037 - RNA, 21 nt, synthetic construct
  source 1..21: mol_type = other RNA
ccagctgcaggaggagctgtt

SEQ ID NO: 1038 - RNA, 21 nt, synthetic construct
  source 1..21: mol_type = other RNA
cagctgcaggaggagctgctt

SEQ ID NO: 1039 - RNA, 21 nt, synthetic construct
  source 1..21: mol_type = other RNA
agctgcaggaggagctgcgtt

SEQ ID NO: 1040 - RNA, 21 nt, synthetic construct
  source 1..21: mol_type = other RNA
gctgcaggaggagctgcggtt

SEQ ID NO: 1041 - RNA, 21 nt, synthetic construct
  source 1..21: mol_type = other RNA
ctgcaggaggagctgcgggtt

SEQ ID NO: 1042 - RNA, 21 nt, synthetic construct
  source 1..21: mol_type = other RNA
tgcaggaggagctgcggggtt

SEQ ID NO: 1043 - RNA, 21 nt, synthetic construct
  source 1..21: mol_type = other RNA
ctccctggggagcagagcatt

SEQ ID NO: 1044 - RNA, 21 nt, synthetic construct
  source 1..21: mol_type = other RNA
gcaggaggagctgcggggctt

SEQ ID NO: 1045 - RNA, 21 nt, synthetic construct
  source 1..21: mol_type = other RNA
caggaggagctgcggggcctt

SEQ ID NO: 1046 - RNA, 21 nt, synthetic construct
  source 1..21: mol_type = other RNA
aggaggagctgcggggccttt

SEQ ID NO: 1047 - RNA, 21 nt, synthetic construct
  source 1..21: mol_type = other RNA
ggaggagctgcggggcctgtt

SEQ ID NO: 1048 - RNA, 21 nt, synthetic construct
  source 1..21: mol_type = other RNA
gaggagctgcggggcctgatt

SEQ ID NO: 1049 - RNA, 21 nt, synthetic construct
  source 1..21: mol_type = other RNA
aggagctgcggggcctgagtt

SEQ ID NO: 1050 - RNA, 21 nt, synthetic construct
  source 1..21: mol_type = other RNA
ggagctgcggggcctgagatt

SEQ ID NO: 1051 - RNA, 21 nt, synthetic construct
  source 1..21: mol_type = other RNA
gagctgcggggcctgagagtt

SEQ ID NO: 1052 - RNA, 21 nt, synthetic construct
  source 1..21: mol_type = other RNA
agctgcggggcctgagagatt

SEQ ID NO: 1053 - RNA, 21 nt, synthetic construct
  source 1..21: mol_type = other RNA
gctgcggggcctgagagagtt

SEQ ID NO: 1054 - RNA, 21 nt, synthetic construct
  source 1..21: mol_type = other RNA
tccctggggagcagagcagtt

SEQ ID NO: 1055 - RNA, 21 nt, synthetic construct
  source 1..21: mol_type = other RNA
ctgcggggcctgagagagatt

SEQ ID NO: 1056 - RNA, 21 nt, synthetic construct
  source 1..21: mol_type = other RNA
tgcggggcctgagagagactt

SEQ ID NO: 1057 - RNA, 21 nt, synthetic construct
  source 1..21: mol_type = other RNA
gcggggcctgagagagacgtt

SEQ ID NO: 1058 - RNA, 21 nt, synthetic construct
  source 1..21: mol_type = other RNA
cggggcctgagagagacgttt

SEQ ID NO: 1059 - RNA, 21 nt, synthetic construct
  source 1..21: mol_type = other RNA
ggggcctgagagagacgtttt

SEQ ID NO: 1060 - RNA, 21 nt, synthetic construct
  source 1..21: mol_type = other RNA
gggcctgagagagacgttctt

SEQ ID NO: 1061 - RNA, 21 nt, synthetic construct
  source 1..21: mol_type = other RNA
ggcctgagagagacgttcatt

SEQ ID NO: 1062 - RNA, 21 nt, synthetic construct
  source 1..21: mol_type = other RNA
gcctgagagagacgttcagtt

SEQ ID NO: 1063 - RNA, 21 nt, synthetic construct
  source 1..21: mol_type = other RNA
cctgagagagacgttcagctt

SEQ ID NO: 1064 - RNA, 21 nt, synthetic construct
  source 1..21: mol_type = other RNA
ctgagagagacgttcagcatt

SEQ ID NO: 1065 - RNA, 21 nt, synthetic construct
  source 1..21: mol_type = other RNA
ccctggggagcagagcagatt

SEQ ID NO: 1066 - RNA, 21 nt, synthetic construct
  source 1..21: mol_type = other RNA
tgagagagacgttcagcaatt

SEQ ID NO: 1067 - RNA, 21 nt, synthetic construct
  source 1..21: mol_type = other RNA
gagagagacgttcagcaactt

SEQ ID NO: 1068 - RNA, 21 nt, synthetic construct
  source 1..21: mol_type = other RNA
agagagacgttcagcaacttt

SEQ ID NO: 1069 - RNA, 21 nt, synthetic construct
  source 1..21: mol_type = other RNA
gagagacgttcagcaactttt

SEQ ID NO: 1070 - RNA, 21 nt, synthetic construct
  source 1..21: mol_type = other RNA
agagacgttcagcaacttctt

SEQ ID NO: 1071 - RNA, 21 nt, synthetic construct
  source 1..21: mol_type = other RNA
gagacgttcagcaacttcatt

SEQ ID NO: 1072 - RNA, 21 nt, synthetic construct
  source 1..21: mol_type = other RNA
acggtgcacggaagagtgatt

SEQ ID NO: 1073 - RNA, 21 nt, synthetic construct
  source 1..21: mol_type = other RNA
agacgttcagcaacttcactt

SEQ ID NO: 1074 - RNA, 21 nt, synthetic construct
  source 1..21: mol_type = other RNA
gacgttcagcaacttcacatt

SEQ ID NO: 1075 - RNA, 21 nt, synthetic construct
  source 1..21: mol_type = other RNA
acgttcagcaacttcacagtt

SEQ ID NO: 1076 - RNA, 21 nt, synthetic construct
  source 1..21: mol_type = other RNA
cgttcagcaacttcacagctt

SEQ ID NO: 1077 - RNA, 21 nt, synthetic construct
  source 1..21: mol_type = other RNA
cctggggagcagagcagagtt

SEQ ID NO: 1078 - RNA, 21 nt, synthetic construct
  source 1..21: mol_type = other RNA
gttcagcaacttcacagcgtt

SEQ ID NO: 1079 - RNA, 21 nt, synthetic construct
  source 1..21: mol_type = other RNA
ttcagcaacttcacagcgatt

SEQ ID NO: 1080 - RNA, 21 nt, synthetic construct
  source 1..21: mol_type = other RNA
tcagcaacttcacagcgagtt

SEQ ID NO: 1081 - RNA, 21 nt, synthetic construct
  source 1..21: mol_type = other RNA
cagcaacttcacagcgagctt

SEQ ID NO: 1082 - RNA, 21 nt, synthetic construct
  source 1..21: mol_type = other RNA
agcaacttcacagcgagcatt

SEQ ID NO: 1083 - RNA, 21 nt, synthetic construct
  source 1..21: mol_type = other RNA
gcaacttcacagcgagcactt

SEQ ID NO: 1084 - RNA, 21 nt, synthetic construct
  source 1..21: mol_type = other RNA
caacttcacagcgagcacgtt

SEQ ID NO: 1085 - RNA, 21 nt, synthetic construct
  source 1..21: mol_type = other RNA
aacttcacagcgagcacggtt

SEQ ID NO: 1086 - RNA, 21 nt, synthetic construct
  source 1..21: mol_type = other RNA
acttcacagcgagcacggatt

SEQ ID NO: 1087 - RNA, 21 nt, synthetic construct
  source 1..21: mol_type = other RNA
cttcacagcgagcacggagtt

SEQ ID NO: 1088 - RNA, 21 nt, synthetic construct
  source 1..21: mol_type = other RNA
ctggggagcagagcagaggtt

SEQ ID NO: 1089 - RNA, 21 nt, synthetic construct
  source 1..21: mol_type = other RNA
ttcacagcgagcacggaggtt

SEQ ID NO: 1090 - RNA, 21 nt, synthetic construct
  source 1..21: mol_type = other RNA
tcacagcgagcacggaggctt

SEQ ID NO: 1091 - RNA, 21 nt, synthetic construct
  source 1..21: mol_type = other RNA
cacagcgagcacggaggcctt

SEQ ID NO: 1092 - RNA, 21 nt, synthetic construct
  source 1..21: mol_type = other RNA
acagcgagcacggaggccctt

SEQ ID NO: 1093 - RNA, 21 nt, synthetic construct
  source 1..21: mol_type = other RNA
cagcgagcacggaggcccatt

SEQ ID NO: 1094 - RNA, 21 nt, synthetic construct
  source 1..21: mol_type = other RNA
agcgagcacggaggcccagtt

SEQ ID NO: 1095 - RNA, 21 nt, synthetic construct
  source 1..21: mol_type = other RNA
gcgagcacggaggcccaggtt

SEQ ID NO: 1096 - RNA, 21 nt, synthetic construct
  source 1..21: mol_type = other RNA
cgagcacggaggcccaggttt

SEQ ID NO: 1097 - RNA, 21 nt, synthetic construct
  source 1..21: mol_type = other RNA
gagcacggaggcccaggtctt

SEQ ID NO: 1098 - RNA, 21 nt, synthetic construct
  source 1..21: mol_type = other RNA
agcacggaggcccaggtcatt

SEQ ID NO: 1099 - RNA, 21 nt, synthetic construct
  source 1..21: mol_type = other RNA
tggggagcagagcagaggctt

SEQ ID NO: 1100 - RNA, 21 nt, synthetic construct
  source 1..21: mol_type = other RNA
gcacggaggcccaggtcaatt

SEQ ID NO: 1101 - RNA, 21 nt, synthetic construct
  source 1..21: mol_type = other RNA
cacggaggcccaggtcaagtt

SEQ ID NO: 1102 - RNA, 21 nt, synthetic construct
  source 1..21: mol_type = other RNA
acggaggcccaggtcaaggtt

SEQ ID NO: 1103 - RNA, 21 nt, synthetic construct
  source 1..21: mol_type = other RNA
cggaggcccaggtcaagggtt

SEQ ID NO: 1104 - RNA, 21 nt, synthetic construct
  source 1..21: mol_type = other RNA
ggaggcccaggtcaagggctt

SEQ ID NO: 1105 - RNA, 21 nt, synthetic construct
  source 1..21: mol_type = other RNA
gaggcccaggtcaagggcttt

SEQ ID NO: 1106 - RNA, 21 nt, synthetic construct
  source 1..21: mol_type = other RNA
aggcccaggtcaagggctttt

SEQ ID NO: 1107 - RNA, 21 nt, synthetic construct
  source 1..21: mol_type = other RNA
ggcccaggtcaagggcttgtt

SEQ ID NO: 1108 - RNA, 21 nt, synthetic construct
  source 1..21: mol_type = other RNA
gcccaggtcaagggcttgatt

SEQ ID NO: 1109 - RNA, 21 nt, synthetic construct
  source 1..21: mol_type = other RNA
cccaggtcaagggcttgagtt

SEQ ID NO: 1110 - RNA, 21 nt, synthetic construct
  source 1..21: mol_type = other RNA
ggggagcagagcagaggcatt

SEQ ID NO: 1111 - RNA, 21 nt, synthetic construct
  source 1..21: mol_type = other RNA
ccaggtcaagggcttgagctt

SEQ ID NO: 1112 - RNA, 21 nt, synthetic construct
  source 1..21: mol_type = other RNA
caggtcaagggcttgagcatt

SEQ ID NO: 1113 - RNA, 21 nt, synthetic construct
  source 1..21: mol_type = other RNA
aggtcaagggcttgagcactt

SEQ ID NO: 1114 - RNA, 21 nt, synthetic construct
  source 1..21: mol_type = other RNA
ggtcaagggcttgagcacctt

SEQ ID NO: 1115 - RNA, 21 nt, synthetic construct
  source 1..21: mol_type = other RNA
gtcaagggcttgagcaccctt

SEQ ID NO: 1116 - RNA, 21 nt, synthetic construct
  source 1..21: mol_type = other RNA
tcaagggcttgagcacccatt

SEQ ID NO: 1117 - RNA, 21 nt, synthetic construct
  source 1..21: mol_type = other RNA
caagggcttgagcacccagtt

SEQ ID NO: 1118 - RNA, 21 nt, synthetic construct
  source 1..21: mol_type = other RNA
aagggcttgagcacccaggtt

SEQ ID NO: 1119 - RNA, 21 nt, synthetic construct
  source 1..21: mol_type = other RNA
agggcttgagcacccagggtt

SEQ ID NO: 1120 - RNA, 21 nt, synthetic construct
  source 1..21: mol_type = other RNA
gggcttgagcacccagggatt

SEQ ID NO: 1121 - RNA, 21 nt, synthetic construct
  source 1..21: mol_type = other RNA
gggagcagagcagaggcaatt

SEQ ID NO: 1122 - RNA, 21 nt, synthetic construct
  source 1..21: mol_type = other RNA
ggcttgagcacccagggagtt

SEQ ID NO: 1123 - RNA, 21 nt, synthetic construct
  source 1..21: mol_type = other RNA
gcttgagcacccagggaggtt

SEQ ID NO: 1124 - RNA, 21 nt, synthetic construct
  source 1..21: mol_type = other RNA
cttgagcacccagggaggctt

SEQ ID NO: 1125 - RNA, 21 nt, synthetic construct
  source 1..21: mol_type = other RNA
ttgagcacccagggaggcatt

SEQ ID NO: 1126 - RNA, 21 nt, synthetic construct
  source 1..21: mol_type = other RNA
tgagcacccagggaggcaatt

SEQ ID NO: 1127 - RNA, 21 nt, synthetic construct
  source 1..21: mol_type = other RNA
gagcacccagggaggcaattt

SEQ ID NO: 1128 - RNA, 21 nt, synthetic construct
  source 1..21: mol_type = other RNA
agcacccagggaggcaatgtt

SEQ ID NO: 1129 - RNA, 21 nt, synthetic construct
  source 1..21: mol_type = other RNA
gcacccagggaggcaatgttt

SEQ ID NO: 1130 - RNA, 21 nt, synthetic construct
  source 1..21: mol_type = other RNA
cacccagggaggcaatgtgtt

SEQ ID NO: 1131 - RNA, 21 nt, synthetic construct
  source 1..21: mol_type = other RNA
acccagggaggcaatgtggtt

SEQ ID NO: 1132 - RNA, 21 nt, synthetic construct
  source 1..21: mol_type = other RNA
ggagcagagcagaggcaactt

SEQ ID NO: 1133 - RNA, 21 nt, synthetic construct
  source 1..21: mol_type = other RNA
cccagggaggcaatgtgggtt

SEQ ID NO: 1134 - RNA, 21 nt, synthetic construct
  source 1..21: mol_type = other RNA
ccagggaggcaatgtgggatt

SEQ ID NO: 1135 - RNA, 21 nt, synthetic construct
  source 1..21: mol_type = other RNA
cagggaggcaatgtgggaatt

SEQ ID NO: 1136 - RNA, 21 nt, synthetic construct
  source 1..21: mol_type = other RNA
agggaggcaatgtgggaagtt

SEQ ID NO: 1137 - RNA, 21 nt, synthetic construct
  source 1..21: mol_type = other RNA
gggaggcaatgtgggaagatt

SEQ ID NO: 1138 - RNA, 21 nt, synthetic construct
  source 1..21: mol_type = other RNA
ggaggcaatgtgggaagaatt

SEQ ID NO: 1139 - RNA, 21 nt, synthetic construct
  source 1..21: mol_type = other RNA
gaggcaatgtgggaagaaatt

SEQ ID NO: 1140 - RNA, 21 nt, synthetic construct
  source 1..21: mol_type = other RNA
aggcaatgtgggaagaaagtt

SEQ ID NO: 1141 - RNA, 21 nt, synthetic construct
  source 1..21: mol_type = other RNA
ggcaatgtgggaagaaagatt

SEQ ID NO: 1142 - RNA, 21 nt, synthetic construct
  source 1..21: mol_type = other RNA
gcaatgtgggaagaaagattt

SEQ ID NO: 1143 - RNA, 21 nt, synthetic construct
  source 1..21: mol_type = other RNA
gagcagagcagaggcaacctt

SEQ ID NO: 1144 - RNA, 21 nt, synthetic construct
  source 1..21: mol_type = other RNA
caatgtgggaagaaagatgtt

SEQ ID NO: 1145 - RNA, 21 nt, synthetic construct
  source 1..21: mol_type = other RNA
aatgtgggaagaaagatgatt

SEQ ID NO: 1146 - RNA, 21 nt, synthetic construct
  source 1..21: mol_type = other RNA
atgtgggaagaaagatgaatt

SEQ ID NO: 1147 - RNA, 21 nt, synthetic construct
  source 1..21: mol_type = other RNA
tgtgggaagaaagatgaagtt

SEQ ID NO: 1148 - RNA, 21 nt, synthetic construct
  source 1..21: mol_type = other RNA
gtgggaagaaagatgaagttt

SEQ ID NO: 1149 - RNA, 21 nt, synthetic construct
  source 1..21: mol_type = other RNA
tgggaagaaagatgaagtctt

SEQ ID NO: 1150 - RNA, 21 nt, synthetic construct
  source 1..21: mol_type = other RNA
gggaagaaagatgaagtcgtt

SEQ ID NO: 1151 - RNA, 21 nt, synthetic construct
  source 1..21: mol_type = other RNA
ggaagaaagatgaagtcgctt

SEQ ID NO: 1152 - RNA, 21 nt, synthetic construct
  source 1..21: mol_type = other RNA
gaagaaagatgaagtcgcttt

SEQ ID NO: 1153 - RNA, 21 nt, synthetic construct
  source 1..21: mol_type = other RNA
aagaaagatgaagtcgctatt

SEQ ID NO: 1154 - RNA, 21 nt, synthetic construct
  source 1..21: mol_type = other RNA
agcagagcagaggcaaccctt

SEQ ID NO: 1155 - RNA, 21 nt, synthetic construct
  source 1..21: mol_type = other RNA
agaaagatgaagtcgctagtt

SEQ ID NO: 1156 - RNA, 21 nt, synthetic construct
  source 1..21: mol_type = other RNA
gaaagatgaagtcgctagatt

SEQ ID NO: 1157 - RNA, 21 nt, synthetic construct
  source 1..21: mol_type = other RNA
aaagatgaagtcgctagagtt

SEQ ID NO: 1158 - RNA, 21 nt, synthetic construct
  source 1..21: mol_type = other RNA
aagatgaagtcgctagagttt

SEQ ID NO: 1159 - RNA, 21 nt, synthetic construct
  source 1..21: mol_type = other RNA
agatgaagtcgctagagtctt

SEQ ID NO: 1160 - RNA, 21 nt, synthetic construct
  source 1..21: mol_type = other RNA
gatgaagtcgctagagtcctt

SEQ ID NO: 1161 - RNA, 21 nt, synthetic construct
  source 1..21: mol_type = other RNA
atgaagtcgctagagtccctt

SEQ ID NO: 1162 - RNA, 21 nt, synthetic construct
  source 1..21: mol_type = other RNA
tgaagtcgctagagtcccatt

SEQ ID NO: 1163 - RNA, 21 nt, synthetic construct
  source 1..21: mol_type = other RNA
gaagtcgctagagtcccagtt

SEQ ID NO: 1164 - RNA, 21 nt, synthetic construct
  source 1..21: mol_type = other RNA
aagtcgctagagtcccagctt

SEQ ID NO: 1165 - RNA, 21 nt, synthetic construct
  source 1..21: mol_type = other RNA
agtcgctagagtcccagcttt

SEQ ID NO: 1166 - RNA, 21 nt, synthetic construct
  source 1..21: mol_type = other RNA
gcagagcagaggcaacccatt

SEQ ID NO: 1167 - RNA, 21 nt, synthetic construct
  source 1..21: mol_type = other RNA
gtcgctagagtcccagctgtt

SEQ ID NO: 1168 - RNA, 21 nt, synthetic construct
  source 1..21: mol_type = other RNA
tcgctagagtcccagctggtt

SEQ ID NO: 1169 - RNA, 21 nt, synthetic construct
  source 1..21: mol_type = other RNA
cgctagagtcccagctggatt

SEQ ID NO: 1170 - RNA, 21 nt, synthetic construct
  source 1..21: mol_type = other RNA
gctagagtcccagctggagtt

SEQ ID NO: 1171 - RNA, 21 nt, synthetic construct
  source 1..21: mol_type = other RNA
ctagagtcccagctggagatt

SEQ ID NO: 1172 - RNA, 21 nt, synthetic construct
  source 1..21: mol_type = other RNA
tagagtcccagctggagaatt

SEQ ID NO: 1173 - RNA, 21 nt, synthetic construct
  source 1..21: mol_type = other RNA
agagtcccagctggagaaatt

SEQ ID NO: 1174 - RNA, 21 nt, synthetic construct
  source 1..21: mol_type = other RNA
gagtcccagctggagaaactt

SEQ ID NO: 1175 - RNA, 21 nt, synthetic construct
  source 1..21: mol_type = other RNA
agtcccagctggagaaacatt

SEQ ID NO: 1176 - RNA, 21 nt, synthetic construct
  source 1..21: mol_type = other RNA
gtcccagctggagaaacagtt

SEQ ID NO: 1177 - RNA, 21 nt, synthetic construct
  source 1..21: mol_type = other RNA
cagagcagaggcaacccattt

SEQ ID NO: 1178 - RNA, 21 nt, synthetic construct
  source 1..21: mol_type = other RNA
tcccagctggagaaacagctt

SEQ ID NO: 1179 - RNA, 21 nt, synthetic construct
  source 1..21: mol_type = other RNA
cccagctggagaaacagcatt

SEQ ID NO: 1180 - RNA, 21 nt, synthetic construct
  source 1..21: mol_type = other RNA
ccagctggagaaacagcagtt

SEQ ID NO: 1181 - RNA, 21 nt, synthetic construct
  source 1..21: mol_type = other RNA
cagctggagaaacagcagatt

SEQ ID NO: 1182 - RNA, 21 nt, synthetic construct
  source 1..21: mol_type = other RNA
agctggagaaacagcagaatt

SEQ ID NO: 1183 - RNA, 21 nt, synthetic construct
  source 1..21: mol_type = other RNA
gctggagaaacagcagaagtt

SEQ ID NO: 1184 - RNA, 21 nt, synthetic construct
  source 1..21: mol_type = other RNA
cggtgcacggaagagtgagtt

SEQ ID NO: 1185 - RNA, 21 nt, synthetic construct
  source 1..21: mol_type = other RNA
ctggagaaacagcagaaggtt

SEQ ID NO: 1186 - RNA, 21 nt, synthetic construct
  source 1..21: mol_type = other RNA
tggagaaacagcagaaggatt

SEQ ID NO: 1187 - RNA, 21 nt, synthetic construct
  source 1..21: mol_type = other RNA
ggagaaacagcagaaggactt

SEQ ID NO: 1188 - RNA, 21 nt, synthetic construct
  source 1..21: mol_type = other RNA
gagaaacagcagaaggacctt

SEQ ID NO: 1189 - RNA, 21 nt, synthetic construct
  source 1..21: mol_type = other RNA
agagcagaggcaacccatctt

SEQ ID NO: 1190 - RNA, 21 nt, synthetic construct
  source 1..21: mol_type = other RNA
agaaacagcagaaggaccttt

SEQ ID NO: 1191 - RNA, 21 nt, synthetic construct
  source 1..21: mol_type = other RNA
gaaacagcagaaggacctgtt

SEQ ID NO: 1192 - RNA, 21 nt, synthetic construct
  source 1..21: mol_type = other RNA
aaacagcagaaggacctgatt

SEQ ID NO: 1193 - RNA, 21 nt, synthetic construct
  source 1..21: mol_type = other RNA
aacagcagaaggacctgagtt

SEQ ID NO: 1194 - RNA, 21 nt, synthetic construct
  source 1..21: mol_type = other RNA
acagcagaaggacctgagttt

SEQ ID NO: 1195 - RNA, 21 nt, synthetic construct
  source 1..21: mol_type = other RNA
cagcagaaggacctgagtgtt

SEQ ID NO: 1196 - RNA, 21 nt, synthetic construct
  source 1..21: mol_type = other RNA
agcagaaggacctgagtgatt

SEQ ID NO: 1197 - RNA, 21 nt, synthetic construct
  source 1..21: mol_type = other RNA
gcagaaggacctgagtgaatt

SEQ ID NO: 1198 - RNA, 21 nt, synthetic construct
  source 1..21: mol_type = other RNA
cagaaggacctgagtgaagtt

SEQ ID NO: 1199 - RNA, 21 nt, synthetic construct
  source 1..21: mol_type = other RNA
agaaggacctgagtgaagatt

SEQ ID NO: 1200 - RNA, 21 nt, synthetic construct
  source 1..21: mol_type = other RNA
gagcagaggcaacccatcctt

SEQ ID NO: 1201 - RNA, 21 nt, synthetic construct
  source 1..21: mol_type = other RNA
gaaggacctgagtgaagattt

SEQ ID NO: 1202 - RNA, 21 nt, synthetic construct
  source 1..21: mol_type = other RNA
aaggacctgagtgaagatctt

SEQ ID NO: 1203 - RNA, 21 nt, synthetic construct
  source 1..21: mol_type = other RNA
aggacctgagtgaagatcatt

SEQ ID NO: 1204 - RNA, 21 nt, synthetic construct
  source 1..21: mol_type = other RNA
ggacctgagtgaagatcactt

SEQ ID NO: 1205 - RNA, 21 nt, synthetic construct
  source 1..21: mol_type = other RNA
gacctgagtgaagatcacttt

SEQ ID NO: 1206 - RNA, 21 nt, synthetic construct
  source 1..21: mol_type = other RNA
acctgagtgaagatcactctt

SEQ ID NO: 1207 - RNA, 21 nt, synthetic construct
  source 1..21: mol_type = other RNA
cctgagtgaagatcactcctt

SEQ ID NO: 1208 - RNA, 21 nt, synthetic construct
  source 1..21: mol_type = other RNA
ctgagtgaagatcactccatt

SEQ ID NO: 1209 - RNA, 21 nt, synthetic construct
  source 1..21: mol_type = other RNA
tgagtgaagatcactccagtt

SEQ ID NO: 1210 - RNA, 21 nt, synthetic construct
  source 1..21: mol_type = other RNA
gagtgaagatcactccagctt

SEQ ID NO: 1211 - RNA, 21 nt, synthetic construct
  source 1..21: mol_type = other RNA
agcagaggcaacccatccctt

SEQ ID NO: 1212 - RNA, 21 nt, synthetic construct
  source 1..21: mol_type = other RNA
agtgaagatcactccagcctt

SEQ ID NO: 1213 - RNA, 21 nt, synthetic construct
  source 1..21: mol_type = other RNA
gtgaagatcactccagccttt

SEQ ID NO: 1214 - RNA, 21 nt, synthetic construct
  source 1..21: mol_type = other RNA
tgaagatcactccagcctgtt

SEQ ID NO: 1215 - RNA, 21 nt, synthetic construct
  source 1..21: mol_type = other RNA
gaagatcactccagcctgctt

SEQ ID NO: 1216 - RNA, 21 nt, synthetic construct
  source 1..21: mol_type = other RNA
aagatcactccagcctgcttt

SEQ ID NO: 1217 - RNA, 21 nt, synthetic construct
  source 1..21: mol_type = other RNA
agatcactccagcctgctgtt

SEQ ID NO: 1218 - RNA, 21 nt, synthetic construct
  source 1..21: mol_type = other RNA
gatcactccagcctgctgctt

SEQ ID NO: 1219 - RNA, 21 nt, synthetic construct
  source 1..21: mol_type = other RNA
atcactccagcctgctgcttt

SEQ ID NO: 1220 - RNA, 21 nt, synthetic construct
  source 1..21: mol_type = other RNA
tcactccagcctgctgctctt

SEQ ID NO: 1221 - RNA, 21 nt, synthetic construct
  source 1..21: mol_type = other RNA
cactccagcctgctgctcctt

SEQ ID NO: 1222 - RNA, 21 nt, synthetic construct
  source 1..21: mol_type = other RNA
gcagaggcaacccatcccctt

SEQ ID NO: 1223 - RNA, 21 nt, synthetic construct
  source 1..21: mol_type = other RNA
actccagcctgctgctccatt

SEQ ID NO: 1224 - RNA, 21 nt, synthetic construct
  source 1..21: mol_type = other RNA
ctccagcctgctgctccactt

SEQ ID NO: 1225 - RNA, 21 nt, synthetic construct
  source 1..21: mol_type = other RNA
tccagcctgctgctccacgtt

SEQ ID NO: 1226 - RNA, 21 nt, synthetic construct
  source 1..21: mol_type = other RNA
ccagcctgctgctccacgttt

SEQ ID NO: 1227 - RNA, 21 nt, synthetic construct
  source 1..21: mol_type = other RNA
cagcctgctgctccacgtgtt

SEQ ID NO: 1228 - RNA, 21 nt, synthetic construct
  source 1..21: mol_type = other RNA
agcctgctgctccacgtgatt

SEQ ID NO: 1229 - RNA, 21 nt, synthetic construct
  source 1..21: mol_type = other RNA
gcctgctgctccacgtgaatt

SEQ ID NO: 1230 - RNA, 21 nt, synthetic construct
  source 1..21: mol_type = other RNA
cctgctgctccacgtgaagtt

SEQ ID NO: 1231 - RNA, 21 nt, synthetic construct
  source 1..21: mol_type = other RNA
ctgctgctccacgtgaagctt

SEQ ID NO: 1232 - RNA, 21 nt, synthetic construct
  source 1..21: mol_type = other RNA
tgctgctccacgtgaagcatt

SEQ ID NO: 1233 - RNA, 21 nt, synthetic construct
  source 1..21: mol_type = other RNA
cagaggcaacccatccccctt

SEQ ID NO: 1234 - RNA, 21 nt, synthetic construct
  source 1..21: mol_type = other RNA
gctgctccacgtgaagcagtt

SEQ ID NO: 1235 - RNA, 21 nt, synthetic construct
  source 1..21: mol_type = other RNA
ctgctccacgtgaagcagttt

SEQ ID NO: 1236 - RNA, 21 nt, synthetic construct
  source 1..21: mol_type = other RNA
tgctccacgtgaagcagtttt

SEQ ID NO: 1237 - RNA, 21 nt, synthetic construct
  source 1..21: mol_type = other RNA
gctccacgtgaagcagttctt

SEQ ID NO: 1238 - RNA, 21 nt, synthetic construct
  source 1..21: mol_type = other RNA
ctccacgtgaagcagttcgtt

SEQ ID NO: 1239 - RNA, 21 nt, synthetic construct
  source 1..21: mol_type = other RNA
tccacgtgaagcagttcgttt

SEQ ID NO: 1240 - RNA, 21 nt, synthetic construct
  source 1..21: mol_type = other RNA
ccacgtgaagcagttcgtgtt

SEQ ID NO: 1241 - RNA, 21 nt, synthetic construct
  source 1..21: mol_type = other RNA
cacgtgaagcagttcgtgttt

SEQ ID NO: 1242 - RNA, 21 nt, synthetic construct
  source 1..21: mol_type = other RNA
acgtgaagcagttcgtgtctt

SEQ ID NO: 1243 - RNA, 21 nt, synthetic construct
  source 1..21: mol_type = other RNA
cgtgaagcagttcgtgtcttt

SEQ ID NO: 1244 - RNA, 21 nt, synthetic construct
  source 1..21: mol_type = other RNA
agaggcaacccatcccccatt

SEQ ID NO: 1245 - RNA, 21 nt, synthetic construct
  source 1..21: mol_type = other RNA
gtgaagcagttcgtgtctgtt

SEQ ID NO: 1246 - RNA, 21 nt, synthetic construct
  source 1..21: mol_type = other RNA
tgaagcagttcgtgtctgatt

SEQ ID NO: 1247 - RNA, 21 nt, synthetic construct
  source 1..21: mol_type = other RNA
gaagcagttcgtgtctgactt

SEQ ID NO: 1248 - RNA, 21 nt, synthetic construct
  source 1..21: mol_type = other RNA
aagcagttcgtgtctgacctt

SEQ ID NO: 1249 - RNA, 21 nt, synthetic construct
  source 1..21: mol_type = other RNA
agcagttcgtgtctgaccttt

SEQ ID NO: 1250 - RNA, 21 nt, synthetic construct
  source 1..21: mol_type = other RNA
gcagttcgtgtctgacctgtt

SEQ ID NO: 1251 - RNA, 21 nt, synthetic construct
  source 1..21: mol_type = other RNA
cagttcgtgtctgacctgctt

SEQ ID NO: 1252 - RNA, 21 nt, synthetic construct
  source 1..21: mol_type = other RNA
agttcgtgtctgacctgcgtt

SEQ ID NO: 1253 - RNA, 21 nt, synthetic construct
  source 1..21: mol_type = other RNA
gttcgtgtctgacctgcggtt

SEQ ID NO: 1254 - RNA, 21 nt, synthetic construct
  source 1..21: mol_type = other RNA
ttcgtgtctgacctgcggatt

SEQ ID NO: 1255 - RNA, 21 nt, synthetic construct
  source 1..21: mol_type = other RNA
gaggcaacccatcccccactt

SEQ ID NO: 1256 - RNA, 21 nt, synthetic construct
  source 1..21: mol_type = other RNA
tcgtgtctgacctgcggagtt

SEQ ID NO: 1257 - RNA, 21 nt, synthetic construct
  source 1..21: mol_type = other RNA
cgtgtctgacctgcggagctt

SEQ ID NO: 1258 - RNA, 21 nt, synthetic construct
  source 1..21: mol_type = other RNA
gtgtctgacctgcggagcctt

SEQ ID NO: 1259 - RNA, 21 nt, synthetic construct
  source 1..21: mol_type = other RNA
tgtctgacctgcggagccttt

SEQ ID NO: 1260 - RNA, 21 nt, synthetic construct
  source 1..21: mol_type = other RNA
gtctgacctgcggagcctgtt

SEQ ID NO: 1261 - RNA, 21 nt, synthetic construct
  source 1..21: mol_type = other RNA
tctgacctgcggagcctgatt

SEQ ID NO: 1262 - RNA, 21 nt, synthetic construct
  source 1..21: mol_type = other RNA
ctgacctgcggagcctgagtt

SEQ ID NO: 1263 - RNA, 21 nt, synthetic construct
  source 1..21: mol_type = other RNA
tgacctgcggagcctgagctt

SEQ ID NO: 1264 - RNA, 21 nt, synthetic construct
  source 1..21: mol_type = other RNA
gacctgcggagcctgagcttt

SEQ ID NO: 1265 - RNA, 21 nt, synthetic construct
  source 1..21: mol_type = other RNA
acctgcggagcctgagctgtt

SEQ ID NO: 1266 - RNA, 21 nt, synthetic construct
  source 1..21: mol_type = other RNA
aggcaacccatcccccacttt

SEQ ID NO: 1267 - RNA, 21 nt, synthetic construct
  source 1..21: mol_type = other RNA
cctgcggagcctgagctgttt

SEQ ID NO: 1268 - RNA, 21 nt, synthetic construct
  source 1..21: mol_type = other RNA
ctgcggagcctgagctgtctt

SEQ ID NO: 1269 - RNA, 21 nt, synthetic construct
  source 1..21: mol_type = other RNA
tgcggagcctgagctgtcatt

SEQ ID NO: 1270 - RNA, 21 nt, synthetic construct
  source 1..21: mol_type = other RNA
gcggagcctgagctgtcagtt

SEQ ID NO: 1271 - RNA, 21 nt, synthetic construct
  source 1..21: mol_type = other RNA
cggagcctgagctgtcagatt

SEQ ID NO: 1272 - RNA, 21 nt, synthetic construct
  source 1..21: mol_type = other RNA
ggagcctgagctgtcagattt

SEQ ID NO: 1273 - RNA, 21 nt, synthetic construct
  source 1..21: mol_type = other RNA
gagcctgagctgtcagatgtt

SEQ ID NO: 1274 - RNA, 21 nt, synthetic construct
  source 1..21: mol_type = other RNA
agcctgagctgtcagatggtt

SEQ ID NO: 1275 - RNA, 21 nt, synthetic construct
  source 1..21: mol_type = other RNA
gcctgagctgtcagatggctt

SEQ ID NO: 1276 - RNA, 21 nt, synthetic construct
  source 1..21: mol_type = other RNA
cctgagctgtcagatggcgtt

SEQ ID NO: 1277 - RNA, 21 nt, synthetic construct
  source 1..21: mol_type = other RNA
ggcaacccatcccccactctt

SEQ ID NO: 1278 - RNA, 21 nt, synthetic construct
  source 1..21: mol_type = other RNA
ctgagctgtcagatggcggtt

SEQ ID NO: 1279 - RNA, 21 nt, synthetic construct
  source 1..21: mol_type = other RNA
tgagctgtcagatggcggctt

SEQ ID NO: 1280 - RNA, 21 nt, synthetic construct
  source 1..21: mol_type = other RNA
gagctgtcagatggcggcgtt

SEQ ID NO: 1281 - RNA, 21 nt, synthetic construct
  source 1..21: mol_type = other RNA
agctgtcagatggcggcgctt

SEQ ID NO: 1282 - RNA, 21 nt, synthetic construct
  source 1..21: mol_type = other RNA
gctgtcagatggcggcgcttt

SEQ ID NO: 1283 - RNA, 21 nt, synthetic construct
  source 1..21: mol_type = other RNA
ctgtcagatggcggcgctctt

SEQ ID NO: 1284 - RNA, 21 nt, synthetic construct
  source 1..21: mol_type = other RNA
tgtcagatggcggcgctcctt

SEQ ID NO: 1285 - RNA, 21 nt, synthetic construct
  source 1..21: mol_type = other RNA
gtcagatggcggcgctccatt

SEQ ID NO: 1286 - RNA, 21 nt, synthetic construct
  source 1..21: mol_type = other RNA
tcagatggcggcgctccagtt

SEQ ID NO: 1287 - RNA, 21 nt, synthetic construct
  source 1..21: mol_type = other RNA
cagatggcggcgctccaggtt

SEQ ID NO: 1288 - RNA, 21 nt, synthetic construct
  source 1..21: mol_type = other RNA
agatggcggcgctccagggtt

SEQ ID NO: 1289 - RNA, 21 nt, synthetic construct
  source 1..21: mol_type = other RNA
gcaacccatcccccactcctt

SEQ ID NO: 1290 - RNA, 21 nt, synthetic construct
  source 1..21: mol_type = other RNA
gatggcggcgctccagggctt

SEQ ID NO: 1291 - RNA, 21 nt, synthetic construct
  source 1..21: mol_type = other RNA
caacccatcccccactccctt

SEQ ID NO: 1292 - RNA, 21 nt, synthetic construct
  source 1..21: mol_type = other RNA
atggcggcgctccagggcatt

SEQ ID NO: 1293 - RNA, 21 nt, synthetic construct
  source 1..21: mol_type = other RNA
tggcggcgctccagggcaatt

SEQ ID NO: 1294 - RNA, 21 nt, synthetic construct
  source 1..21: mol_type = other RNA
ggcggcgctccagggcaattt

SEQ ID NO: 1295 - RNA, 21 nt, synthetic construct
  source 1..21: mol_type = other RNA
gcggcgctccagggcaatgtt

SEQ ID NO: 1296 - RNA, 21 nt, synthetic construct
  source 1..21: mol_type = other RNA
cggcgctccagggcaatggtt

SEQ ID NO: 1297 - RNA, 21 nt, synthetic construct
  source 1..21: mol_type = other RNA
ggtgcacggaagagtgaggtt

SEQ ID NO: 1298 - RNA, 21 nt, synthetic construct
  source 1..21: mol_type = other RNA
ggcgctccagggcaatggctt

SEQ ID NO: 1299 - RNA, 21 nt, synthetic construct
  source 1..21: mol_type = other RNA
gcgctccagggcaatggcttt

SEQ ID NO: 1300 - RNA, 21 nt, synthetic construct
  source 1..21: mol_type = other RNA
cgctccagggcaatggctctt

SEQ ID NO: 1301 - RNA, 21 nt, synthetic construct
  source 1..21: mol_type = other RNA
gctccagggcaatggctcatt

SEQ ID NO: 1302 - RNA, 21 nt, synthetic construct
  source 1..21: mol_type = other RNA
ctccagggcaatggctcagtt

SEQ ID NO: 1303 - RNA, 21 nt, synthetic construct
  source 1..21: mol_type = other RNA
aacccatcccccactcccatt

SEQ ID NO: 1304 - RNA, 21 nt, synthetic construct
  source 1..21: mol_type = other RNA
tccagggcaatggctcagatt

SEQ ID NO: 1305 - RNA, 21 nt, synthetic construct
  source 1..21: mol_type = other RNA
ccagggcaatggctcagaatt

SEQ ID NO: 1306 - RNA, 21 nt, synthetic construct
  source 1..21: mol_type = other RNA
cagggcaatggctcagaaatt

SEQ ID NO: 1307 - RNA, 21 nt, synthetic construct
  source 1..21: mol_type = other RNA
agggcaatggctcagaaagtt

SEQ ID NO: 1308 - RNA, 21 nt, synthetic construct
  source 1..21: mol_type = other RNA
gggcaatggctcagaaaggtt

SEQ ID NO: 1309 - RNA, 21 nt, synthetic construct
  source 1..21: mol_type = other RNA
ggcaatggctcagaaaggatt

SEQ ID NO: 1310 - RNA, 21 nt, synthetic construct
  source 1..21: mol_type = other RNA
gcaatggctcagaaaggactt

SEQ ID NO: 1311 - RNA, 21 nt, synthetic construct
  source 1..21: mol_type = other RNA
caatggctcagaaaggacctt

SEQ ID NO: 1312 - RNA, 21 nt, synthetic construct
  source 1..21: mol_type = other RNA
aatggctcagaaaggaccttt

SEQ ID NO: 1313 - RNA, 21 nt, synthetic construct
  source 1..21: mol_type = other RNA
atggctcagaaaggacctgtt

SEQ ID NO: 1314 - RNA, 21 nt, synthetic construct
  source 1..21: mol_type = other RNA
acccatcccccactcccactt

SEQ ID NO: 1315 - RNA, 21 nt, synthetic construct
  source 1..21: mol_type = other RNA
tggctcagaaaggacctgctt

SEQ ID NO: 1316 - RNA, 21 nt, synthetic construct
  source 1..21: mol_type = other RNA
ggctcagaaaggacctgcttt

SEQ ID NO: 1317 - RNA, 21 nt, synthetic construct
  source 1..21: mol_type = other RNA
gctcagaaaggacctgctgtt

SEQ ID NO: 1318 - RNA, 21 nt, synthetic construct
  source 1..21: mol_type = other RNA
ctcagaaaggacctgctgctt

SEQ ID NO: 1319 - RNA, 21 nt, synthetic construct
  source 1..21: mol_type = other RNA
tcagaaaggacctgctgcctt

SEQ ID NO: 1320 - RNA, 21 nt, synthetic construct
  source 1..21: mol_type = other RNA
cagaaaggacctgctgccctt

SEQ ID NO: 1321 - RNA, 21 nt, synthetic construct
  source 1..21: mol_type = other RNA
agaaaggacctgctgcccgtt

SEQ ID NO: 1322 - RNA, 21 nt, synthetic construct
  source 1..21: mol_type = other RNA
gaaaggacctgctgcccggtt

SEQ ID NO: 1323 - RNA, 21 nt, synthetic construct
  source 1..21: mol_type = other RNA
aaaggacctgctgcccggttt

SEQ ID NO: 1324 - RNA, 21 nt, synthetic construct
  source 1..21: mol_type = other RNA
aaggacctgctgcccggtctt

SEQ ID NO: 1325 - RNA, 21 nt, synthetic construct
  source 1..21: mol_type = other RNA
cccatcccccactcccacctt

SEQ ID NO: 1326 - RNA, 21 nt, synthetic construct
  source 1..21: mol_type = other RNA
aggacctgctgcccggtcatt

SEQ ID NO: 1327 - RNA, 21 nt, synthetic construct
  source 1..21: mol_type = other RNA
ggacctgctgcccggtcaatt

SEQ ID NO: 1328 - RNA, 21 nt, synthetic construct
  source 1..21: mol_type = other RNA
gacctgctgcccggtcaactt

SEQ ID NO: 1329 - RNA, 21 nt, synthetic construct
  source 1..21: mol_type = other RNA
acctgctgcccggtcaacttt

SEQ ID NO: 1330 - RNA, 21 nt, synthetic construct
  source 1..21: mol_type = other RNA
cctgctgcccggtcaactgtt

SEQ ID NO: 1331 - RNA, 21 nt, synthetic construct
  source 1..21: mol_type = other RNA
ctgctgcccggtcaactggtt

SEQ ID NO: 1332 - RNA, 21 nt, synthetic construct
  source 1..21: mol_type = other RNA
tgctgcccggtcaactgggtt

SEQ ID NO: 1333 - RNA, 21 nt, synthetic construct
  source 1..21: mol_type = other RNA
gctgcccggtcaactgggttt

SEQ ID NO: 1334 - RNA, 21 nt, synthetic construct
  source 1..21: mol_type = other RNA
ctgcccggtcaactgggtgtt

SEQ ID NO: 1335 - RNA, 21 nt, synthetic construct
  source 1..21: mol_type = other RNA
tgcccggtcaactgggtggtt

SEQ ID NO: 1336 - RNA, 21 nt, synthetic construct
  source 1..21: mol_type = other RNA
ccatcccccactcccaccctt

SEQ ID NO: 1337 - RNA, 21 nt, synthetic construct
  source 1..21: mol_type = other RNA
gcccggtcaactgggtggatt

SEQ ID NO: 1338 - RNA, 21 nt, synthetic construct
  source 1..21: mol_type = other RNA
cccggtcaactgggtggagtt

SEQ ID NO: 1339 - RNA, 21 nt, synthetic construct
  source 1..21: mol_type = other RNA
ccggtcaactgggtggagctt

SEQ ID NO: 1340 - RNA, 21 nt, synthetic construct
  source 1..21: mol_type = other RNA
cggtcaactgggtggagcatt

SEQ ID NO: 1341 - RNA, 21 nt, synthetic construct
  source 1..21: mol_type = other RNA
ggtcaactgggtggagcactt

SEQ ID NO: 1342 - RNA, 21 nt, synthetic construct
  source 1..21: mol_type = other RNA
gtcaactgggtggagcacgtt

SEQ ID NO: 1343 - RNA, 21 nt, synthetic construct
  source 1..21: mol_type = other RNA
tcaactgggtggagcacgatt

SEQ ID NO: 1344 - RNA, 21 nt, synthetic construct
  source 1..21: mol_type = other RNA
caactgggtggagcacgagtt

SEQ ID NO: 1345 - RNA, 21 nt, synthetic construct
  source 1..21: mol_type = other RNA
aactgggtggagcacgagctt

SEQ ID NO: 1346 - RNA, 21 nt, synthetic construct
  source 1..21: mol_type = other RNA
actgggtggagcacgagcgtt

SEQ ID NO: 1347 - RNA, 21 nt, synthetic construct
  source 1..21: mol_type = other RNA
catcccccactcccacccctt

SEQ ID NO: 1348 - RNA, 21 nt, synthetic construct
  source 1..21: mol_type = other RNA
ctgggtggagcacgagcgctt

SEQ ID NO: 1349 - RNA, 21 nt, synthetic construct
  source 1..21: mol_type = other RNA
tgggtggagcacgagcgcatt

SEQ ID NO: 1350 - RNA, 21 nt, synthetic construct
  source 1..21: mol_type = other RNA
gggtggagcacgagcgcagtt

SEQ ID NO: 1351 - RNA, 21 nt, synthetic construct
  source 1..21: mol_type = other RNA
ggtggagcacgagcgcagctt

SEQ ID NO: 1352 - RNA, 21 nt, synthetic construct
  source 1..21: mol_type = other RNA
gtggagcacgagcgcagcttt

SEQ ID NO: 1353 - RNA, 21 nt, synthetic construct
  source 1..21: mol_type = other RNA
tggagcacgagcgcagctgtt

SEQ ID NO: 1354 - RNA, 21 nt, synthetic construct
  source 1..21: mol_type = other RNA
ggagcacgagcgcagctgctt

SEQ ID NO: 1355 - RNA, 21 nt, synthetic construct
  source 1..21: mol_type = other RNA
gagcacgagcgcagctgcttt

SEQ ID NO: 1356 - RNA, 21 nt, synthetic construct
  source 1..21: mol_type = other RNA
agcacgagcgcagctgctatt

SEQ ID NO: 1357 - RNA, 21 nt, synthetic construct
  source 1..21: mol_type = other RNA
gcacgagcgcagctgctactt

SEQ ID NO: 1358 - RNA, 21 nt, synthetic construct
  source 1..21: mol_type = other RNA
atcccccactcccaccccctt

SEQ ID NO: 1359 - RNA, 21 nt, synthetic construct
  source 1..21: mol_type = other RNA
cacgagcgcagctgctacttt

SEQ ID NO: 1360 - RNA, 21 nt, synthetic construct
  source 1..21: mol_type = other RNA
acgagcgcagctgctactgtt

SEQ ID NO: 1361 - RNA, 21 nt, synthetic construct
  source 1..21: mol_type = other RNA
cgagcgcagctgctactggtt

SEQ ID NO: 1362 - RNA, 21 nt, synthetic construct
  source 1..21: mol_type = other RNA
gagcgcagctgctactggttt

SEQ ID NO: 1363 - RNA, 21 nt, synthetic construct
  source 1..21: mol_type = other RNA
agcgcagctgctactggtttt

SEQ ID NO: 1364 - RNA, 21 nt, synthetic construct
  source 1..21: mol_type = other RNA
gcgcagctgctactggttctt

SEQ ID NO: 1365 - RNA, 21 nt, synthetic construct
  source 1..21: mol_type = other RNA
cgcagctgctactggttcttt

SEQ ID NO: 1366 - RNA, 21 nt, synthetic construct
  source 1..21: mol_type = other RNA
gcagctgctactggttctctt

SEQ ID NO: 1367 - RNA, 21 nt, synthetic construct
  source 1..21: mol_type = other RNA
cagctgctactggttctcttt

SEQ ID NO: 1368 - RNA, 21 nt, synthetic construct
  source 1..21: mol_type = other RNA
agctgctactggttctctctt

SEQ ID NO: 1369 - RNA, 21 nt, synthetic construct
  source 1..21: mol_type = other RNA
tcccccactcccacccccatt

SEQ ID NO: 1370 - RNA, 21 nt, synthetic construct
  source 1..21: mol_type = other RNA
gctgctactggttctctcgtt

SEQ ID NO: 1371 - RNA, 21 nt, synthetic construct
  source 1..21: mol_type = other RNA
ctgctactggttctctcgctt

SEQ ID NO: 1372 - RNA, 21 nt, synthetic construct
  source 1..21: mol_type = other RNA
tgctactggttctctcgcttt

SEQ ID NO: 1373 - RNA, 21 nt, synthetic construct
  source 1..21: mol_type = other RNA
gctactggttctctcgctctt

SEQ ID NO: 1374 - RNA, 21 nt, synthetic construct
  source 1..21: mol_type = other RNA
ctactggttctctcgctcctt

SEQ ID NO: 1375 - RNA, 21 nt, synthetic construct
  source 1..21: mol_type = other RNA
tactggttctctcgctccgtt

SEQ ID NO: 1376 - RNA, 21 nt, synthetic construct
  source 1..21: mol_type = other RNA
actggttctctcgctccggtt

SEQ ID NO: 1377 - RNA, 21 nt, synthetic construct
  source 1..21: mol_type = other RNA
ctggttctctcgctccgggtt

SEQ ID NO: 1378 - RNA, 21 nt, synthetic construct
  source 1..21: mol_type = other RNA
tggttctctcgctccgggatt

SEQ ID NO: 1379 - RNA, 21 nt, synthetic construct
  source 1..21: mol_type = other RNA
ggttctctcgctccgggaatt

SEQ ID NO: 1380 - RNA, 21 nt, synthetic construct
  source 1..21: mol_type = other RNA
cccccactcccacccccactt

SEQ ID NO: 1381 - RNA, 21 nt, synthetic construct
  source 1..21: mol_type = other RNA
gttctctcgctccgggaagtt

SEQ ID NO: 1382 - RNA, 21 nt, synthetic construct
  source 1..21: mol_type = other RNA
ttctctcgctccgggaaggtt

SEQ ID NO: 1383 - RNA, 21 nt, synthetic construct
  source 1..21: mol_type = other RNA
tctctcgctccgggaaggctt

SEQ ID NO: 1384 - RNA, 21 nt, synthetic construct
  source 1..21: mol_type = other RNA
ctctcgctccgggaaggcctt

SEQ ID NO: 1385 - RNA, 21 nt, synthetic construct
  source 1..21: mol_type = other RNA
tctcgctccgggaaggccttt

SEQ ID NO: 1386 - RNA, 21 nt, synthetic construct
  source 1..21: mol_type = other RNA
ctcgctccgggaaggcctgtt

SEQ ID NO: 1387 - RNA, 21 nt, synthetic construct
  source 1..21: mol_type = other RNA
tcgctccgggaaggcctggtt

SEQ ID NO: 1388 - RNA, 21 nt, synthetic construct
  source 1..21: mol_type = other RNA
cgctccgggaaggcctgggtt

SEQ ID NO: 1389 - RNA, 21 nt, synthetic construct
  source 1..21: mol_type = other RNA
gctccgggaaggcctgggctt

SEQ ID NO: 1390 - RNA, 21 nt, synthetic construct
  source 1..21: mol_type = other RNA
ctccgggaaggcctgggcttt

SEQ ID NO: 1391 - RNA, 21 nt, synthetic construct
  source 1..21: mol_type = other RNA
ccccactcccacccccacatt

SEQ ID NO: 1392 - RNA, 21 nt, synthetic construct
  source 1..21: mol_type = other RNA
tccgggaaggcctgggctgtt

SEQ ID NO: 1393 - RNA, 21 nt, synthetic construct
  source 1..21: mol_type = other RNA
ccgggaaggcctgggctgatt

SEQ ID NO: 1394 - RNA, 21 nt, synthetic construct
  source 1..21: mol_type = other RNA
cgggaaggcctgggctgactt

SEQ ID NO: 1395 - RNA, 21 nt, synthetic construct
  source 1..21: mol_type = other RNA
gggaaggcctgggctgacgtt

SEQ ID NO: 1396 - RNA, 21 nt, synthetic construct
  source 1..21: mol_type = other RNA
ggaaggcctgggctgacgctt

SEQ ID NO: 1397 - RNA, 21 nt, synthetic construct
  source 1..21: mol_type = other RNA
gaaggcctgggctgacgcctt

SEQ ID NO: 1398 - RNA, 21 nt, synthetic construct
  source 1..21: mol_type = other RNA
aaggcctgggctgacgccgtt

SEQ ID NO: 1399 - RNA, 21 nt, synthetic construct
  source 1..21: mol_type = other RNA
aggcctgggctgacgccgatt

SEQ ID NO: 1400 - RNA, 21 nt, synthetic construct
  source 1..21: mol_type = other RNA
ggcctgggctgacgccgactt

SEQ ID NO: 1401 - RNA, 21 nt, synthetic construct
  source 1..21: mol_type = other RNA
gcctgggctgacgccgacatt

SEQ ID NO: 1402 - RNA, 21 nt, synthetic construct
  source 1..21: mol_type = other RNA
cccactcccacccccacactt

SEQ ID NO: 1403 - RNA, 21 nt, synthetic construct
  source 1..21: mol_type = other RNA
cctgggctgacgccgacaatt

SEQ ID NO: 1404 - RNA, 21 nt, synthetic construct
  source 1..21: mol_type = other RNA
ctgggctgacgccgacaactt

SEQ ID NO: 1405 - RNA, 21 nt, synthetic construct
  source 1..21: mol_type = other RNA
tgggctgacgccgacaacttt

SEQ ID NO: 1406 - RNA, 21 nt, synthetic construct
  source 1..21: mol_type = other RNA
gggctgacgccgacaactatt

SEQ ID NO: 1407 - RNA, 21 nt, synthetic construct
  source 1..21: mol_type = other RNA
ggctgacgccgacaactactt

SEQ ID NO: 1408 - RNA, 21 nt, synthetic construct
  source 1..21: mol_type = other RNA
gctgacgccgacaactacttt

SEQ ID NO: 1409 - RNA, 21 nt, synthetic construct
  source 1..21: mol_type = other RNA
gtgcacggaagagtgaggttt

SEQ ID NO: 1410 - RNA, 21 nt, synthetic construct
  source 1..21: mol_type = other RNA
ctgacgccgacaactactgtt

SEQ ID NO: 1411 - RNA, 21 nt, synthetic construct
  source 1..21: mol_type = other RNA
tgacgccgacaactactgctt

SEQ ID NO: 1412 - RNA, 21 nt, synthetic construct
  source 1..21: mol_type = other RNA
gacgccgacaactactgcctt

SEQ ID NO: 1413 - RNA, 21 nt, synthetic construct
  source 1..21: mol_type = other RNA
acgccgacaactactgccgtt

SEQ ID NO: 1414 - RNA, 21 nt, synthetic construct
  source 1..21: mol_type = other RNA
ccactcccacccccacacttt

SEQ ID NO: 1415 - RNA, 21 nt, synthetic construct
  source 1..21: mol_type = other RNA
cgccgacaactactgccggtt

SEQ ID NO: 1416 - RNA, 21 nt, synthetic construct
  source 1..21: mol_type = other RNA
gccgacaactactgccggctt

SEQ ID NO: 1417 - RNA, 21 nt, synthetic construct
  source 1..21: mol_type = other RNA
ccgacaactactgccggcttt

SEQ ID NO: 1418 - RNA, 21 nt, synthetic construct
  source 1..21: mol_type = other RNA
cgacaactactgccggctgtt

SEQ ID NO: 1419 - RNA, 21 nt, synthetic construct
  source 1..21: mol_type = other RNA
gacaactactgccggctggtt

SEQ ID NO: 1420 - RNA, 21 nt, synthetic construct
  source 1..21: mol_type = other RNA
acaactactgccggctggatt

SEQ ID NO: 1421 - RNA, 21 nt, synthetic construct
  source 1..21: mol_type = other RNA
caactactgccggctggagtt

SEQ ID NO: 1422 - RNA, 21 nt, synthetic construct
  source 1..21: mol_type = other RNA
aactactgccggctggaggtt

SEQ ID NO: 1423 - RNA, 21 nt, synthetic construct
  source 1..21: mol_type = other RNA
actactgccggctggaggatt

SEQ ID NO: 1424 - RNA, 21 nt, synthetic construct
  source 1..21: mol_type = other RNA
ctactgccggctggaggactt

SEQ ID NO: 1425 - RNA, 21 nt, synthetic construct
  source 1..21: mol_type = other RNA
cactcccacccccacactctt

SEQ ID NO: 1426 - RNA, 21 nt, synthetic construct
  source 1..21: mol_type = other RNA
tactgccggctggaggacgtt

SEQ ID NO: 1427 - RNA, 21 nt, synthetic construct
  source 1..21: mol_type = other RNA
actgccggctggaggacgctt

SEQ ID NO: 1428 - RNA, 21 nt, synthetic construct
  source 1..21: mol_type = other RNA
ctgccggctggaggacgcgtt

SEQ ID NO: 1429 - RNA, 21 nt, synthetic construct
  source 1..21: mol_type = other RNA
tgccggctggaggacgcgctt

SEQ ID NO: 1430 - RNA, 21 nt, synthetic construct
  source 1..21: mol_type = other RNA
gccggctggaggacgcgcatt

SEQ ID NO: 1431 - RNA, 21 nt, synthetic construct
  source 1..21: mol_type = other RNA
ccggctggaggacgcgcactt

SEQ ID NO: 1432 - RNA, 21 nt, synthetic construct
  source 1..21: mol_type = other RNA
cggctggaggacgcgcacctt

SEQ ID NO: 1433 - RNA, 21 nt, synthetic construct
  source 1..21: mol_type = other RNA
ggctggaggacgcgcaccttt

SEQ ID NO: 1434 - RNA, 21 nt, synthetic construct
  source 1..21: mol_type = other RNA
gctggaggacgcgcacctgtt

SEQ ID NO: 1435 - RNA, 21 nt, synthetic construct
  source 1..21: mol_type = other RNA
ctggaggacgcgcacctggtt

SEQ ID NO: 1436 - RNA, 21 nt, synthetic construct
  source 1..21: mol_type = other RNA
actcccacccccacactcctt

SEQ ID NO: 1437 - RNA, 21 nt, synthetic construct
  source 1..21: mol_type = other RNA
tggaggacgcgcacctggttt

SEQ ID NO: 1438 - RNA, 21 nt, synthetic construct
  source 1..21: mol_type = other RNA
ggaggacgcgcacctggtgtt

SEQ ID NO: 1439 - RNA, 21 nt, synthetic construct
  source 1..21: mol_type = other RNA
gaggacgcgcacctggtggtt

SEQ ID NO: 1440 - RNA, 21 nt, synthetic construct
  source 1..21: mol_type = other RNA
aggacgcgcacctggtggttt

SEQ ID NO: 1441 - RNA, 21 nt, synthetic construct
  source 1..21: mol_type = other RNA
ggacgcgcacctggtggtgtt

SEQ ID NO: 1442 - RNA, 21 nt, synthetic construct
  source 1..21: mol_type = other RNA
gacgcgcacctggtggtggtt

SEQ ID NO: 1443 - RNA, 21 nt, synthetic construct
  source 1..21: mol_type = other RNA
acgcgcacctggtggtggttt

SEQ ID NO: 1444 - RNA, 21 nt, synthetic construct
  source 1..21: mol_type = other RNA
cgcgcacctggtggtggtctt

SEQ ID NO: 1445 - RNA, 21 nt, synthetic construct
  source 1..21: mol_type = other RNA
gcgcacctggtggtggtcatt

SEQ ID NO: 1446 - RNA, 21 nt, synthetic construct
  source 1..21: mol_type = other RNA
cgcacctggtggtggtcactt

SEQ ID NO: 1447 - RNA, 21 nt, synthetic construct
  source 1..21: mol_type = other RNA
ctcccacccccacactccctt

SEQ ID NO: 1448 - RNA, 21 nt, synthetic construct
  source 1..21: mol_type = other RNA
gcacctggtggtggtcacgtt

SEQ ID NO: 1449 - RNA, 21 nt, synthetic construct
  source 1..21: mol_type = other RNA
cacctggtggtggtcacgttt

SEQ ID NO: 1450 - RNA, 21 nt, synthetic construct
  source 1..21: mol_type = other RNA
acctggtggtggtcacgtctt

SEQ ID NO: 1451 - RNA, 21 nt, synthetic construct
  source 1..21: mol_type = other RNA
cctggtggtggtcacgtcctt

SEQ ID NO: 1452 - RNA, 21 nt, synthetic construct
  source 1..21: mol_type = other RNA
ctggtggtggtcacgtccttt

SEQ ID NO: 1453 - RNA, 21 nt, synthetic construct
  source 1..21: mol_type = other RNA
tggtggtggtcacgtcctgtt

SEQ ID NO: 1454 - RNA, 21 nt, synthetic construct
  source 1..21: mol_type = other RNA
ggtggtggtcacgtcctggtt

SEQ ID NO: 1455 - RNA, 21 nt, synthetic construct
  source 1..21: mol_type = other RNA
gtggtggtcacgtcctgggtt

SEQ ID NO: 1456 - RNA, 21 nt, synthetic construct
  source 1..21: mol_type = other RNA
tggtggtcacgtcctgggatt

SEQ ID NO: 1457 - RNA, 21 nt, synthetic construct
  source 1..21: mol_type = other RNA
ggtggtcacgtcctgggagtt

SEQ ID NO: 1458 - RNA, 21 nt, synthetic construct
  source 1..21: mol_type = other RNA
tcccacccccacactcccctt

SEQ ID NO: 1459 - RNA, 21 nt, synthetic construct
  source 1..21: mol_type = other RNA
gtggtcacgtcctgggaggtt

SEQ ID NO: 1460 - RNA, 21 nt, synthetic construct
  source 1..21: mol_type = other RNA
tggtcacgtcctgggaggatt

SEQ ID NO: 1461 - RNA, 21 nt, synthetic construct
  source 1..21: mol_type = other RNA
ggtcacgtcctgggaggagtt

SEQ ID NO: 1462 - RNA, 21 nt, synthetic construct
  source 1..21: mol_type = other RNA
gtcacgtcctgggaggagctt

SEQ ID NO: 1463 - RNA, 21 nt, synthetic construct
  source 1..21: mol_type = other RNA
tcacgtcctgggaggagcatt

SEQ ID NO: 1464 - RNA, 21 nt, synthetic construct
  source 1..21: mol_type = other RNA
cacgtcctgggaggagcagtt

SEQ ID NO: 1465 - RNA, 21 nt, synthetic construct
  source 1..21: mol_type = other RNA
acgtcctgggaggagcagatt

SEQ ID NO: 1466 - RNA, 21 nt, synthetic construct
  source 1..21: mol_type = other RNA
cgtcctgggaggagcagaatt

SEQ ID NO: 1467 - RNA, 21 nt, synthetic construct
  source 1..21: mol_type = other RNA
gtcctgggaggagcagaaatt

SEQ ID NO: 1468 - RNA, 21 nt, synthetic construct
  source 1..21: mol_type = other RNA
tcctgggaggagcagaaattt

SEQ ID NO: 1469 - RNA, 21 nt, synthetic construct
  source 1..21: mol_type = other RNA
cccacccccacactccccttt

SEQ ID NO: 1470 - RNA, 21 nt, synthetic construct
  source 1..21: mol_type = other RNA
cctgggaggagcagaaatttt

SEQ ID NO: 1471 - RNA, 21 nt, synthetic construct
  source 1..21: mol_type = other RNA
ctgggaggagcagaaattttt

SEQ ID NO: 1472 - RNA, 21 nt, synthetic construct
  source 1..21: mol_type = other RNA
tgggaggagcagaaatttgtt

SEQ ID NO: 1473 - RNA, 21 nt, synthetic construct
  source 1..21: mol_type = other RNA
gggaggagcagaaatttgttt

SEQ ID NO: 1474 - RNA, 21 nt, synthetic construct
  source 1..21: mol_type = other RNA
ggaggagcagaaatttgtctt

SEQ ID NO: 1475 - RNA, 21 nt, synthetic construct
  source 1..21: mol_type = other RNA
gaggagcagaaatttgtcctt

SEQ ID NO: 1476 - RNA, 21 nt, synthetic construct
  source 1..21: mol_type = other RNA
aggagcagaaatttgtccatt

SEQ ID NO: 1477 - RNA, 21 nt, synthetic construct
  source 1..21: mol_type = other RNA
ggagcagaaatttgtccagtt

SEQ ID NO: 1478 - RNA, 21 nt, synthetic construct
  source 1..21: mol_type = other RNA
gagcagaaatttgtccagctt

SEQ ID NO: 1479 - RNA, 21 nt, synthetic construct
  source 1..21: mol_type = other RNA
agcagaaatttgtccagcatt

SEQ ID NO: 1480 - RNA, 21 nt, synthetic construct
  source 1..21: mol_type = other RNA
gcagaaatttgtccagcactt

SEQ ID NO: 1481 - RNA, 21 nt, synthetic construct
  source 1..21: mol_type = other RNA
ccacccccacactcccctatt

SEQ ID NO: 1482 - RNA, 21 nt, synthetic construct
  source 1..21: mol_type = other RNA
cagaaatttgtccagcacctt

SEQ ID NO: 1483 - RNA, 21 nt, synthetic construct
  source 1..21: mol_type = other RNA
agaaatttgtccagcaccatt

SEQ ID NO: 1484 - RNA, 21 nt, synthetic construct
  source 1..21: mol_type = other RNA
gaaatttgtccagcaccactt

SEQ ID NO: 1485 - RNA, 21 nt, synthetic construct
  source 1..21: mol_type = other RNA
aaatttgtccagcaccacatt

SEQ ID NO: 1486 - RNA, 21 nt, synthetic construct
  source 1..21: mol_type = other RNA
aatttgtccagcaccacattt

SEQ ID NO: 1487 - RNA, 21 nt, synthetic construct
  source 1..21: mol_type = other RNA
atttgtccagcaccacatatt

SEQ ID NO: 1488 - RNA, 21 nt, synthetic construct
  source 1..21: mol_type = other RNA
tttgtccagcaccacatagtt

SEQ ID NO: 1489 - RNA, 21 nt, synthetic construct
  source 1..21: mol_type = other RNA
ttgtccagcaccacataggtt

SEQ ID NO: 1490 - RNA, 21 nt, synthetic construct
  source 1..21: mol_type = other RNA
accatcagctcagaaaagatt

SEQ ID NO: 1491 - RNA, 21 nt, synthetic construct
  source 1..21: mol_type = other RNA
ccatcagctcagaaaagactt

SEQ ID NO: 1492 - RNA, 21 nt, synthetic construct
  source 1..21: mol_type = other RNA
catcagctcagaaaagacttt

SEQ ID NO: 1493 - RNA, 21 nt, synthetic construct
  source 1..21: mol_type = other RNA
atcagctcagaaaagactctt

SEQ ID NO: 1494 - RNA, 21 nt, synthetic construct
  source 1..21: mol_type = other RNA
tcagctcagaaaagactcctt

SEQ ID NO: 1495 - RNA, 21 nt, synthetic construct
  source 1..21: mol_type = other RNA
cagctcagaaaagactccctt

SEQ ID NO: 1496 - RNA, 21 nt, synthetic construct
  source 1..21: mol_type = other RNA
agctcagaaaagactcccatt

SEQ ID NO: 1497 - RNA, 21 nt, synthetic construct
  source 1..21: mol_type = other RNA
gctcagaaaagactcccagtt

SEQ ID NO: 1498 - RNA, 21 nt, synthetic construct
  source 1..21: mol_type = other RNA
ctcagaaaagactcccagctt

SEQ ID NO: 1499 - RNA, 21 nt, synthetic construct
  source 1..21: mol_type = other RNA
tcagaaaagactcccagcttt

SEQ ID NO: 1500 - RNA, 21 nt, synthetic construct
  source 1..21: mol_type = other RNA
cagaaaagactcccagctgtt

SEQ ID NO: 1501 - RNA, 21 nt, synthetic construct
  source 1..21: mol_type = other RNA
agaaaagactcccagctgctt

SEQ ID NO: 1502 - RNA, 21 nt, synthetic construct
  source 1..21: mol_type = other RNA
gaaaagactcccagctgcatt

SEQ ID NO: 1503 - RNA, 21 nt, synthetic construct
  source 1..21: mol_type = other RNA
aaaagactcccagctgcagtt

SEQ ID NO: 1504 - RNA, 21 nt, synthetic construct
  source 1..21: mol_type = other RNA
aaagactcccagctgcaggtt

SEQ ID NO: 1505 - RNA, 21 nt, synthetic construct
  source 1..21: mol_type = other RNA
aagactcccagctgcaggatt

SEQ ID NO: 1506 - RNA, 21 nt, synthetic construct
  source 1..21: mol_type = other RNA
agactcccagctgcaggagtt

SEQ ID NO: 1507 - RNA, 21 nt, synthetic construct
  source 1..21: mol_type = other RNA
gactcccagctgcaggaggtt

SEQ ID NO: 1508 - RNA, 21 nt, synthetic construct
  source 1..21: mol_type = other RNA
gcctatgtggtgctggacatt

SEQ ID NO: 1509 - RNA, 21 nt, synthetic construct
  source 1..21: mol_type = other RNA
ggcctatgtggtgctggactt

SEQ ID NO: 1510 - RNA, 21 nt, synthetic construct
  source 1..21: mol_type = other RNA
ttaggggagtgtgggggtgtt

SEQ ID NO: 1511 - RNA, 21 nt, synthetic construct
  source 1..21: mol_type = other RNA
gggcctatgtggtgctggatt

SEQ ID NO: 1512 - RNA, 21 nt, synthetic construct
  source 1..21: mol_type = other RNA
agggcctatgtggtgctggtt

SEQ ID NO: 1513 - RNA, 21 nt, synthetic construct
  source 1..21: mol_type = other RNA
cagggcctatgtggtgctgtt

SEQ ID NO: 1514 - RNA, 21 nt, synthetic construct
  source 1..21: mol_type = other RNA
acagggcctatgtggtgcttt

SEQ ID NO: 1515 - RNA, 21 nt, synthetic construct
  source 1..21: mol_type = other RNA
cacagggcctatgtggtgctt

SEQ ID NO: 1516 - RNA, 21 nt, synthetic construct
  source 1..21: mol_type = other RNA
tcacagggcctatgtggtgtt

SEQ ID NO: 1517 - RNA, 21 nt, synthetic construct
  source 1..21: mol_type = other RNA
ttcacagggcctatgtggttt

SEQ ID NO: 1518 - RNA, 21 nt, synthetic construct
  source 1..21: mol_type = other RNA
gttcacagggcctatgtggtt

SEQ ID NO: 1519 - RNA, 21 nt, synthetic construct
  source 1..21: mol_type = other RNA
tgttcacagggcctatgtgtt

SEQ ID NO: 1520 - RNA, 21 nt, synthetic construct
  source 1..21: mol_type = other RNA
gtgttcacagggcctatgttt

SEQ ID NO: 1521 - RNA, 21 nt, synthetic construct
  source 1..21: mol_type = other RNA
cttaggggagtgtgggggttt

SEQ ID NO: 1522 - RNA, 21 nt, synthetic construct
  source 1..21: mol_type = other RNA
ggtgttcacagggcctatgtt

SEQ ID NO: 1523 - RNA, 21 nt, synthetic construct
  source 1..21: mol_type = other RNA
aggtgttcacagggcctattt

SEQ ID NO: 1524 - RNA, 21 nt, synthetic construct
  source 1..21: mol_type = other RNA
caggtgttcacagggcctatt

SEQ ID NO: 1525 - RNA, 21 nt, synthetic construct
  source 1..21: mol_type = other RNA
ccaggtgttcacagggccttt

SEQ ID NO: 1526 - RNA, 21 nt, synthetic construct
  source 1..21: mol_type = other RNA
tccaggtgttcacagggcctt

SEQ ID NO: 1527 - RNA, 21 nt, synthetic construct
  source 1..21: mol_type = other RNA
atccaggtgttcacagggctt

SEQ ID NO: 1528 - RNA, 21 nt, synthetic construct
  source 1..21: mol_type = other RNA
catccaggtgttcacagggtt

SEQ ID NO: 1529 - RNA, 21 nt, synthetic construct
  source 1..21: mol_type = other RNA
ccatccaggtgttcacaggtt

SEQ ID NO: 1530 - RNA, 21 nt, synthetic construct
  source 1..21: mol_type = other RNA
cccatccaggtgttcacagtt

SEQ ID NO: 1531 - RNA, 21 nt, synthetic construct
  source 1..21: mol_type = other RNA
gcccatccaggtgttcacatt

SEQ ID NO: 1532 - RNA, 21 nt, synthetic construct
  source 1..21: mol_type = other RNA
acttaggggagtgtgggggtt

SEQ ID NO: 1533 - RNA, 21 nt, synthetic construct
  source 1..21: mol_type = other RNA
ggcccatccaggtgttcactt

SEQ ID NO: 1534 - RNA, 21 nt, synthetic construct
  source 1..21: mol_type = other RNA
aggcccatccaggtgttcatt

SEQ ID NO: 1535 - RNA, 21 nt, synthetic construct
  source 1..21: mol_type = other RNA
gaggcccatccaggtgttctt

SEQ ID NO: 1536 - RNA, 21 nt, synthetic construct
  source 1..21: mol_type = other RNA
ggaggcccatccaggtgtttt

SEQ ID NO: 1537 - RNA, 21 nt, synthetic construct
  source 1..21: mol_type = other RNA
tggaggcccatccaggtgttt

SEQ ID NO: 1538 - RNA, 21 nt, synthetic construct
  source 1..21: mol_type = other RNA
gtggaggcccatccaggtgtt

SEQ ID NO: 1539 - RNA, 21 nt, synthetic construct
  source 1..21: mol_type = other RNA
cacctcactcttccgtgcatt

SEQ ID NO: 1540 - RNA, 21 nt, synthetic construct
  source 1..21: mol_type = other RNA
cgtggaggcccatccaggttt

SEQ ID NO: 1541 - RNA, 21 nt, synthetic construct
  source 1..21: mol_type = other RNA
tcgtggaggcccatccaggtt

SEQ ID NO: 1542 - RNA, 21 nt, synthetic construct
  source 1..21: mol_type = other RNA
gtcgtggaggcccatccagtt

SEQ ID NO: 1543 - RNA, 21 nt, synthetic construct
  source 1..21: mol_type = other RNA
ggtcgtggaggcccatccatt

SEQ ID NO: 1544 - RNA, 21 nt, synthetic construct
  source 1..21: mol_type = other RNA
aacttaggggagtgtggggtt

SEQ ID NO: 1545 - RNA, 21 nt, synthetic construct
  source 1..21: mol_type = other RNA
tggtcgtggaggcccatcctt

SEQ ID NO: 1546 - RNA, 21 nt, synthetic construct
  source 1..21: mol_type = other RNA
ttggtcgtggaggcccatctt

SEQ ID NO: 1547 - RNA, 21 nt, synthetic construct
  source 1..21: mol_type = other RNA
tttggtcgtggaggcccattt

SEQ ID NO: 1548 - RNA, 21 nt, synthetic construct
  source 1..21: mol_type = other RNA
ttttggtcgtggaggcccatt

SEQ ID NO: 1549 - RNA, 21 nt, synthetic construct
  source 1..21: mol_type = other RNA
gttttggtcgtggaggccctt

SEQ ID NO: 1550 - RNA, 21 nt, synthetic construct
  source 1..21: mol_type = other RNA
cgttttggtcgtggaggcctt

SEQ ID NO: 1551 - RNA, 21 nt, synthetic construct
  source 1..21: mol_type = other RNA
ccgttttggtcgtggaggctt

SEQ ID NO: 1552 - RNA, 21 nt, synthetic construct
  source 1..21: mol_type = other RNA
cccgttttggtcgtggaggtt

SEQ ID NO: 1553 - RNA, 21 nt, synthetic construct
  source 1..21: mol_type = other RNA
gcccgttttggtcgtggagtt

SEQ ID NO: 1554 - RNA, 21 nt, synthetic construct
  source 1..21: mol_type = other RNA
ggcccgttttggtcgtggatt

SEQ ID NO: 1555 - RNA, 21 nt, synthetic construct
  source 1..21: mol_type = other RNA
gaacttaggggagtgtgggtt

SEQ ID NO: 1556 - RNA, 21 nt, synthetic construct
  source 1..21: mol_type = other RNA
gggcccgttttggtcgtggtt

SEQ ID NO: 1557 - RNA, 21 nt, synthetic construct
  source 1..21: mol_type = other RNA
agggcccgttttggtcgtgtt

SEQ ID NO: 1558 - RNA, 21 nt, synthetic construct
  source 1..21: mol_type = other RNA
cagggcccgttttggtcgttt

SEQ ID NO: 1559 - RNA, 21 nt, synthetic construct
  source 1..21: mol_type = other RNA
ccagggcccgttttggtcgtt

SEQ ID NO: 1560 - RNA, 21 nt, synthetic construct
  source 1..21: mol_type = other RNA
tccagggcccgttttggtctt

SEQ ID NO: 1561 - RNA, 21 nt, synthetic construct
  source 1..21: mol_type = other RNA
ttccagggcccgttttggttt

SEQ ID NO: 1562 - RNA, 21 nt, synthetic construct
  source 1..21: mol_type = other RNA
cttccagggcccgttttggtt

SEQ ID NO: 1563 - RNA, 21 nt, synthetic construct
  source 1..21: mol_type = other RNA
acttccagggcccgttttgtt

SEQ ID NO: 1564 - RNA, 21 nt, synthetic construct
  source 1..21: mol_type = other RNA
cacttccagggcccgtttttt

SEQ ID NO: 1565 - RNA, 21 nt, synthetic construct
  source 1..21: mol_type = other RNA
ccacttccagggcccgttttt

SEQ ID NO: 1566 - RNA, 21 nt, synthetic construct
  source 1..21: mol_type = other RNA
ggaacttaggggagtgtggtt

SEQ ID NO: 1567 - RNA, 21 nt, synthetic construct
  source 1..21: mol_type = other RNA
cccacttccagggcccgtttt

SEQ ID NO: 1568 - RNA, 21 nt, synthetic construct
  source 1..21: mol_type = other RNA
acccacttccagggcccgttt

SEQ ID NO: 1569 - RNA, 21 nt, synthetic construct
  source 1..21: mol_type = other RNA
cacccacttccagggcccgtt

SEQ ID NO: 1570 - RNA, 21 nt, synthetic construct
  source 1..21: mol_type = other RNA
ccacccacttccagggccctt

SEQ ID NO: 1571 - RNA, 21 nt, synthetic construct
  source 1..21: mol_type = other RNA
tccacccacttccagggcctt

SEQ ID NO: 1572 - RNA, 21 nt, synthetic construct
  source 1..21: mol_type = other RNA
gtccacccacttccagggctt

SEQ ID NO: 1573 - RNA, 21 nt, synthetic construct
  source 1..21: mol_type = other RNA
cgtccacccacttccagggtt

SEQ ID NO: 1574 - RNA, 21 nt, synthetic construct
  source 1..21: mol_type = other RNA
ccgtccacccacttccaggtt

SEQ ID NO: 1575 - RNA, 21 nt, synthetic construct
  source 1..21: mol_type = other RNA
cccgtccacccacttccagtt

SEQ ID NO: 1576 - RNA, 21 nt, synthetic construct
  source 1..21: mol_type = other RNA
tcccgtccacccacttccatt

SEQ ID NO: 1577 - RNA, 21 nt, synthetic construct
  source 1..21: mol_type = other RNA
tggaacttaggggagtgtgtt

SEQ ID NO: 1578 - RNA, 21 nt, synthetic construct
  source 1..21: mol_type = other RNA
gtcccgtccacccacttcctt

SEQ ID NO: 1579 - RNA, 21 nt, synthetic construct
  source 1..21: mol_type = other RNA
cgtcccgtccacccacttctt

SEQ ID NO: 1580 - RNA, 21 nt, synthetic construct
  source 1..21: mol_type = other RNA
ccgtcccgtccacccactttt

SEQ ID NO: 1581 - RNA, 21 nt, synthetic construct
  source 1..21: mol_type = other RNA
tccgtcccgtccacccacttt

SEQ ID NO: 1582 - RNA, 21 nt, synthetic construct
  source 1..21: mol_type = other RNA
gtccgtcccgtccacccactt

SEQ ID NO: 1583 - RNA, 21 nt, synthetic construct
  source 1..21: mol_type = other RNA
agtccgtcccgtccacccatt

SEQ ID NO: 1584 - RNA, 21 nt, synthetic construct
  source 1..21: mol_type = other RNA
tagtccgtcccgtccaccctt

SEQ ID NO: 1585 - RNA, 21 nt, synthetic construct
  source 1..21: mol_type = other RNA
gtagtccgtcccgtccacctt

SEQ ID NO: 1586 - RNA, 21 nt, synthetic construct
  source 1..21: mol_type = other RNA
cgtagtccgtcccgtccactt

SEQ ID NO: 1587 - RNA, 21 nt, synthetic construct
  source 1..21: mol_type = other RNA
tcgtagtccgtcccgtccatt

SEQ ID NO: 1588 - RNA, 21 nt, synthetic construct
  source 1..21: mol_type = other RNA
ttggaacttaggggagtgttt

SEQ ID NO: 1589 - RNA, 21 nt, synthetic construct
  source 1..21: mol_type = other RNA
ctcgtagtccgtcccgtcctt

SEQ ID NO: 1590 - RNA, 21 nt, synthetic construct
  source 1..21: mol_type = other RNA
tctcgtagtccgtcccgtctt

SEQ ID NO: 1591 - RNA, 21 nt, synthetic construct
  source 1..21: mol_type = other RNA
gtctcgtagtccgtcccgttt

SEQ ID NO: 1592 - RNA, 21 nt, synthetic construct
  source 1..21: mol_type = other RNA
cgtctcgtagtccgtcccgtt

SEQ ID NO: 1593 - RNA, 21 nt, synthetic construct
  source 1..21: mol_type = other RNA
ccgtctcgtagtccgtccctt

SEQ ID NO: 1594 - RNA, 21 nt, synthetic construct
  source 1..21: mol_type = other RNA
cccgtctcgtagtccgtcctt

SEQ ID NO: 1595 - RNA, 21 nt, synthetic construct
  source 1..21: mol_type = other RNA
gcccgtctcgtagtccgtctt

SEQ ID NO: 1596 - RNA, 21 nt, synthetic construct
  source 1..21: mol_type = other RNA
agcccgtctcgtagtccgttt

SEQ ID NO: 1597 - RNA, 21 nt, synthetic construct
  source 1..21: mol_type = other RNA
aagcccgtctcgtagtccgtt

SEQ ID NO: 1598 - RNA, 21 nt, synthetic construct
  source 1..21: mol_type = other RNA
gaagcccgtctcgtagtcctt

SEQ ID NO: 1599 - RNA, 21 nt, synthetic construct
  source 1..21: mol_type = other RNA
attggaacttaggggagtgtt

SEQ ID NO: 1600 - RNA, 21 nt, synthetic construct
  source 1..21: mol_type = other RNA
tgaagcccgtctcgtagtctt

SEQ ID NO: 1601 - RNA, 21 nt, synthetic construct
  source 1..21: mol_type = other RNA
ttgaagcccgtctcgtagttt

SEQ ID NO: 1602 - RNA, 21 nt, synthetic construct
  source 1..21: mol_type = other RNA
cttgaagcccgtctcgtagtt

SEQ ID NO: 1603 - RNA, 21 nt, synthetic construct
  source 1..21: mol_type = other RNA
tcttgaagcccgtctcgtatt

SEQ ID NO: 1604 - RNA, 21 nt, synthetic construct
  source 1..21: mol_type = other RNA
ttcttgaagcccgtctcgttt

SEQ ID NO: 1605 - RNA, 21 nt, synthetic construct
  source 1..21: mol_type = other RNA
gttcttgaagcccgtctcgtt

SEQ ID NO: 1606 - RNA, 21 nt, synthetic construct
  source 1..21: mol_type = other RNA
agttcttgaagcccgtctctt

SEQ ID NO: 1607 - RNA, 21 nt, synthetic construct
  source 1..21: mol_type = other RNA
cagttcttgaagcccgtcttt

SEQ ID NO: 1608 - RNA, 21 nt, synthetic construct
  source 1..21: mol_type = other RNA
ccagttcttgaagcccgtctt

SEQ ID NO: 1609 - RNA, 21 nt, synthetic construct
  source 1..21: mol_type = other RNA
tccagttcttgaagcccgttt

SEQ ID NO: 1610 - RNA, 21 nt, synthetic construct
  source 1..21: mol_type = other RNA
gattggaacttaggggagttt

SEQ ID NO: 1611 - RNA, 21 nt, synthetic construct
  source 1..21: mol_type = other RNA
ctccagttcttgaagcccgtt

SEQ ID NO: 1612 - RNA, 21 nt, synthetic construct
  source 1..21: mol_type = other RNA
cctccagttcttgaagccctt

SEQ ID NO: 1613 - RNA, 21 nt, synthetic construct
  source 1..21: mol_type = other RNA
gcctccagttcttgaagcctt

SEQ ID NO: 1614 - RNA, 21 nt, synthetic construct
  source 1..21: mol_type = other RNA
ggcctccagttcttgaagctt

SEQ ID NO: 1615 - RNA, 21 nt, synthetic construct
  source 1..21: mol_type = other RNA
cggcctccagttcttgaagtt

SEQ ID NO: 1616 - RNA, 21 nt, synthetic construct
  source 1..21: mol_type = other RNA
ccggcctccagttcttgaatt

SEQ ID NO: 1617 - RNA, 21 nt, synthetic construct
  source 1..21: mol_type = other RNA
tccggcctccagttcttgatt

SEQ ID NO: 1618 - RNA, 21 nt, synthetic construct
  source 1..21: mol_type = other RNA
ctccggcctccagttcttgtt

SEQ ID NO: 1619 - RNA, 21 nt, synthetic construct
  source 1..21: mol_type = other RNA
gctccggcctccagttctttt

SEQ ID NO: 1620 - RNA, 21 nt, synthetic construct
  source 1..21: mol_type = other RNA
tgctccggcctccagttcttt

SEQ ID NO: 1621 - RNA, 21 nt, synthetic construct
  source 1..21: mol_type = other RNA
ggattggaacttaggggagtt

SEQ ID NO: 1622 - RNA, 21 nt, synthetic construct
  source 1..21: mol_type = other RNA
ctgctccggcctccagttctt

SEQ ID NO: 1623 - RNA, 21 nt, synthetic construct
  source 1..21: mol_type = other RNA
gctgctccggcctccagtttt

SEQ ID NO: 1624 - RNA, 21 nt, synthetic construct
  source 1..21: mol_type = other RNA
ggctgctccggcctccagttt

SEQ ID NO: 1625 - RNA, 21 nt, synthetic construct
  source 1..21: mol_type = other RNA
cggctgctccggcctccagtt

SEQ ID NO: 1626 - RNA, 21 nt, synthetic construct
  source 1..21: mol_type = other RNA
ccggctgctccggcctccatt

SEQ ID NO: 1627 - RNA, 21 nt, synthetic construct
  source 1..21: mol_type = other RNA
tccggctgctccggcctcctt

SEQ ID NO: 1628 - RNA, 21 nt, synthetic construct
  source 1..21: mol_type = other RNA
gtccggctgctccggcctctt

SEQ ID NO: 1629 - RNA, 21 nt, synthetic construct
  source 1..21: mol_type = other RNA
cgtccggctgctccggccttt

SEQ ID NO: 1630 - RNA, 21 nt, synthetic construct
  source 1..21: mol_type = other RNA
tcgtccggctgctccggcctt

SEQ ID NO: 1631 - RNA, 21 nt, synthetic construct
  source 1..21: mol_type = other RNA
gtcgtccggctgctccggctt

SEQ ID NO: 1632 - RNA, 21 nt, synthetic construct
  source 1..21: mol_type = other RNA
tggattggaacttaggggatt

SEQ ID NO: 1633 - RNA, 21 nt, synthetic construct
  source 1..21: mol_type = other RNA
agtcgtccggctgctccggtt

SEQ ID NO: 1634 - RNA, 21 nt, synthetic construct
  source 1..21: mol_type = other RNA
cagtcgtccggctgctccgtt

SEQ ID NO: 1635 - RNA, 21 nt, synthetic construct
  source 1..21: mol_type = other RNA
ccagtcgtccggctgctcctt

SEQ ID NO: 1636 - RNA, 21 nt, synthetic construct
  source 1..21: mol_type = other RNA
accagtcgtccggctgctctt

SEQ ID NO: 1637 - RNA, 21 nt, synthetic construct
  source 1..21: mol_type = other RNA
taccagtcgtccggctgcttt

SEQ ID NO: 1638 - RNA, 21 nt, synthetic construct
  source 1..21: mol_type = other RNA
gtaccagtcgtccggctgctt

SEQ ID NO: 1639 - RNA, 21 nt, synthetic construct
  source 1..21: mol_type = other RNA
cgtaccagtcgtccggctgtt

SEQ ID NO: 1640 - RNA, 21 nt, synthetic construct
  source 1..21: mol_type = other RNA
ccgtaccagtcgtccggcttt

SEQ ID NO: 1641 - RNA, 21 nt, synthetic construct
  source 1..21: mol_type = other RNA
gccgtaccagtcgtccggctt

SEQ ID NO: 1642 - RNA, 21 nt, synthetic construct
  source 1..21: mol_type = other RNA
ggccgtaccagtcgtccggtt

SEQ ID NO: 1643 - RNA, 21 nt, synthetic construct
  source 1..21: mol_type = other RNA
atggattggaacttaggggtt

SEQ ID NO: 1644 - RNA, 21 nt, synthetic construct
  source 1..21: mol_type = other RNA
tggccgtaccagtcgtccgtt

SEQ ID NO: 1645 - RNA, 21 nt, synthetic construct
  source 1..21: mol_type = other RNA
gtggccgtaccagtcgtcctt

SEQ ID NO: 1646 - RNA, 21 nt, synthetic construct
  source 1..21: mol_type = other RNA
cgtggccgtaccagtcgtctt

SEQ ID NO: 1647 - RNA, 21 nt, synthetic construct
  source 1..21: mol_type = other RNA
ccgtggccgtaccagtcgttt

SEQ ID NO: 1648 - RNA, 21 nt, synthetic construct
  source 1..21: mol_type = other RNA
cccgtggccgtaccagtcgtt

SEQ ID NO: 1649 - RNA, 21 nt, synthetic construct
  source 1..21: mol_type = other RNA
gcccgtggccgtaccagtctt

SEQ ID NO: 1650 - RNA, 21 nt, synthetic construct
  source 1..21: mol_type = other RNA
agcccgtggccgtaccagttt

SEQ ID NO: 1651 - RNA, 21 nt, synthetic construct
  source 1..21: mol_type = other RNA
tcacctcactcttccgtgctt

SEQ ID NO: 1652 - RNA, 21 nt, synthetic construct
  source 1..21: mol_type = other RNA
gagcccgtggccgtaccagtt

SEQ ID NO: 1653 - RNA, 21 nt, synthetic construct
  source 1..21: mol_type = other RNA
cgagcccgtggccgtaccatt

SEQ ID NO: 1654 - RNA, 21 nt, synthetic construct
  source 1..21: mol_type = other RNA
ccgagcccgtggccgtacctt

SEQ ID NO: 1655 - RNA, 21 nt, synthetic construct
  source 1..21: mol_type = other RNA
aatggattggaacttagggtt

SEQ ID NO: 1656 - RNA, 21 nt, synthetic construct
  source 1..21: mol_type = other RNA
tccgagcccgtggccgtactt

SEQ ID NO: 1657 - RNA, 21 nt, synthetic construct
  source 1..21: mol_type = other RNA
ctccgagcccgtggccgtatt

SEQ ID NO: 1658 - RNA, 21 nt, synthetic construct
  source 1..21: mol_type = other RNA
cctccgagcccgtggccgttt

SEQ ID NO: 1659 - RNA, 21 nt, synthetic construct
  source 1..21: mol_type = other RNA
tcctccgagcccgtggccgtt

SEQ ID NO: 1660 - RNA, 21 nt, synthetic construct
  source 1..21: mol_type = other RNA
ctcctccgagcccgtggcctt

SEQ ID NO: 1661 - RNA, 21 nt, synthetic construct
  source 1..21: mol_type = other RNA
cctcctccgagcccgtggctt

SEQ ID NO: 1662 - RNA, 21 nt, synthetic construct
  source 1..21: mol_type = other RNA
gcctcctccgagcccgtggtt

SEQ ID NO: 1663 - RNA, 21 nt, synthetic construct
  source 1..21: mol_type = other RNA
cgcctcctccgagcccgtgtt

SEQ ID NO: 1664 - RNA, 21 nt, synthetic construct
  source 1..21: mol_type = other RNA
tcgcctcctccgagcccgttt

SEQ ID NO: 1665 - RNA, 21 nt, synthetic construct
  source 1..21: mol_type = other RNA
ctcgcctcctccgagcccgtt

SEQ ID NO: 1666 - RNA, 21 nt, synthetic construct
  source 1..21: mol_type = other RNA
aaatggattggaacttaggtt

SEQ ID NO: 1667 - RNA, 21 nt, synthetic construct
  source 1..21: mol_type = other RNA
cctcgcctcctccgagccctt

SEQ ID NO: 1668 - RNA, 21 nt, synthetic construct
  source 1..21: mol_type = other RNA
tcctcgcctcctccgagcctt

SEQ ID NO: 1669 - RNA, 21 nt, synthetic construct
  source 1..21: mol_type = other RNA
gtcctcgcctcctccgagctt

SEQ ID NO: 1670 - RNA, 21 nt, synthetic construct
  source 1..21: mol_type = other RNA
agtcctcgcctcctccgagtt

SEQ ID NO: 1671 - RNA, 21 nt, synthetic construct
  source 1..21: mol_type = other RNA
cagtcctcgcctcctccgatt

SEQ ID NO: 1672 - RNA, 21 nt, synthetic construct
  source 1..21: mol_type = other RNA
acagtcctcgcctcctccgtt

SEQ ID NO: 1673 - RNA, 21 nt, synthetic construct
  source 1..21: mol_type = other RNA
cacagtcctcgcctcctcctt

SEQ ID NO: 1674 - RNA, 21 nt, synthetic construct
  source 1..21: mol_type = other RNA
gcacagtcctcgcctcctctt

SEQ ID NO: 1675 - RNA, 21 nt, synthetic construct
  source 1..21: mol_type = other RNA
ggcacagtcctcgcctccttt

SEQ ID NO: 1676 - RNA, 21 nt, synthetic construct
  source 1..21: mol_type = other RNA
gggcacagtcctcgcctcctt

SEQ ID NO: 1677 - RNA, 21 nt, synthetic construct
  source 1..21: mol_type = other RNA
gaaatggattggaacttagtt

SEQ ID NO: 1678 - RNA, 21 nt, synthetic construct
  source 1..21: mol_type = other RNA
tgggcacagtcctcgcctctt

SEQ ID NO: 1679 - RNA, 21 nt, synthetic construct
  source 1..21: mol_type = other RNA
gtgggcacagtcctcgccttt

SEQ ID NO: 1680 - RNA, 21 nt, synthetic construct
  source 1..21: mol_type = other RNA
agtgggcacagtcctcgcctt

SEQ ID NO: 1681 - RNA, 21 nt, synthetic construct
  source 1..21: mol_type = other RNA
aagtgggcacagtcctcgctt

SEQ ID NO: 1682 - RNA, 21 nt, synthetic construct
  source 1..21: mol_type = other RNA
gaagtgggcacagtcctcgtt

SEQ ID NO: 1683 - RNA, 21 nt, synthetic construct
  source 1..21: mol_type = other RNA
tgaagtgggcacagtcctctt

SEQ ID NO: 1684 - RNA, 21 nt, synthetic construct
  source 1..21: mol_type = other RNA
gtgaagtgggcacagtccttt

SEQ ID NO: 1685 - RNA, 21 nt, synthetic construct
  source 1..21: mol_type = other RNA
ggtgaagtgggcacagtcctt

SEQ ID NO: 1686 - RNA, 21 nt, synthetic construct
  source 1..21: mol_type = other RNA
cggtgaagtgggcacagtctt

SEQ ID NO: 1687 - RNA, 21 nt, synthetic construct
  source 1..21: mol_type = other RNA
tcggtgaagtgggcacagttt

SEQ ID NO: 1688 - RNA, 21 nt, synthetic construct
  source 1..21: mol_type = other RNA
ggaaatggattggaacttatt

SEQ ID NO: 1689 - RNA, 21 nt, synthetic construct
  source 1..21: mol_type = other RNA
gtcggtgaagtgggcacagtt

SEQ ID NO: 1690 - RNA, 21 nt, synthetic construct
  source 1..21: mol_type = other RNA
cgtcggtgaagtgggcacatt

SEQ ID NO: 1691 - RNA, 21 nt, synthetic construct
  source 1..21: mol_type = other RNA
tcgtcggtgaagtgggcactt

SEQ ID NO: 1692 - RNA, 21 nt, synthetic construct
  source 1..21: mol_type = other RNA
gtcgtcggtgaagtgggcatt

SEQ ID NO: 1693 - RNA, 21 nt, synthetic construct
  source 1..21: mol_type = other RNA
cgtcgtcggtgaagtgggctt

SEQ ID NO: 1694 - RNA, 21 nt, synthetic construct
  source 1..21: mol_type = other RNA
ccgtcgtcggtgaagtgggtt

SEQ ID NO: 1695 - RNA, 21 nt, synthetic construct
  source 1..21: mol_type = other RNA
gccgtcgtcggtgaagtggtt

SEQ ID NO: 1696 - RNA, 21 nt, synthetic construct
  source 1..21: mol_type = other RNA
ggccgtcgtcggtgaagtgtt

SEQ ID NO: 1697 - RNA, 21 nt, synthetic construct
  source 1..21: mol_type = other RNA
cggccgtcgtcggtgaagttt

SEQ ID NO: 1698 - RNA, 21 nt, synthetic construct
  source 1..21: mol_type = other RNA
gcggccgtcgtcggtgaagtt

SEQ ID NO: 1699 - RNA, 21 nt, synthetic construct
  source 1..21: mol_type = other RNA
tggaaatggattggaactttt

SEQ ID NO: 1700 - RNA, 21 nt, synthetic construct
  source 1..21: mol_type = other RNA
agcggccgtcgtcggtgaatt

SEQ ID NO: 1701 - RNA, 21 nt, synthetic construct
  source 1..21: mol_type = other RNA
cagcggccgtcgtcggtgatt

SEQ ID NO: 1702 - RNA, 21 nt, synthetic construct
  source 1..21: mol_type = other RNA
ccagcggccgtcgtcggtgtt

SEQ ID NO: 1703 - RNA, 21 nt, synthetic construct
  source 1..21: mol_type = other RNA
tccagcggccgtcgtcggttt

SEQ ID NO: 1704 - RNA, 21 nt, synthetic construct
  source 1..21: mol_type = other RNA
ttccagcggccgtcgtcggtt

SEQ ID NO: 1705 - RNA, 21 nt, synthetic construct
  source 1..21: mol_type = other RNA
gttccagcggccgtcgtcgtt

SEQ ID NO: 1706 - RNA, 21 nt, synthetic construct
  source 1..21: mol_type = other RNA
cgttccagcggccgtcgtctt

SEQ ID NO: 1707 - RNA, 21 nt, synthetic construct
  source 1..21: mol_type = other RNA
tcgttccagcggccgtcgttt

SEQ ID NO: 1708 - RNA, 21 nt, synthetic construct
  source 1..21: mol_type = other RNA
gtcgttccagcggccgtcgtt

SEQ ID NO: 1709 - RNA, 21 nt, synthetic construct
  source 1..21: mol_type = other RNA
cgtcgttccagcggccgtctt

SEQ ID NO: 1710 - RNA, 21 nt, synthetic construct
  source 1..21: mol_type = other RNA
gtggaaatggattggaacttt

SEQ ID NO: 1711 - RNA, 21 nt, synthetic construct
  source 1..21: mol_type = other RNA
tcgtcgttccagcggccgttt

SEQ ID NO: 1712 - RNA, 21 nt, synthetic construct
  source 1..21: mol_type = other RNA
gtcgtcgttccagcggccgtt

SEQ ID NO: 1713 - RNA, 21 nt, synthetic construct
  source 1..21: mol_type = other RNA
cgtcgtcgttccagcggcctt

SEQ ID NO: 1714 - RNA, 21 nt, synthetic construct
  source 1..21: mol_type = other RNA
acgtcgtcgttccagcggctt

SEQ ID NO: 1715 - RNA, 21 nt, synthetic construct
  source 1..21: mol_type = other RNA
gacgtcgtcgttccagcggtt

SEQ ID NO: 1716 - RNA, 21 nt, synthetic construct
  source 1..21: mol_type = other RNA
agacgtcgtcgttccagcgtt

SEQ ID NO: 1717 - RNA, 21 nt, synthetic construct
  source 1..21: mol_type = other RNA
cagacgtcgtcgttccagctt

SEQ ID NO: 1718 - RNA, 21 nt, synthetic construct
  source 1..21: mol_type = other RNA
gcagacgtcgtcgttccagtt

SEQ ID NO: 1719 - RNA, 21 nt, synthetic construct
  source 1..21: mol_type = other RNA
cttccgtgcaccgtttgggtt

SEQ ID NO: 1720 - RNA, 21 nt, synthetic construct
  source 1..21: mol_type = other RNA
ggcagacgtcgtcgttccatt

SEQ ID NO: 1721 - RNA, 21 nt, synthetic construct
  source 1..21: mol_type = other RNA
tggcagacgtcgtcgttcctt

SEQ ID NO: 1722 - RNA, 21 nt, synthetic construct
  source 1..21: mol_type = other RNA
ggtggaaatggattggaactt

SEQ ID NO: 1723 - RNA, 21 nt, synthetic construct
  source 1..21: mol_type = other RNA
ctggcagacgtcgtcgttctt

SEQ ID NO: 1724 - RNA, 21 nt, synthetic construct
  source 1..21: mol_type = other RNA
tctggcagacgtcgtcgtttt

SEQ ID NO: 1725 - RNA, 21 nt, synthetic construct
  source 1..21: mol_type = other RNA
ctctggcagacgtcgtcgttt

SEQ ID NO: 1726 - RNA, 21 nt, synthetic construct
  source 1..21: mol_type = other RNA
cctctggcagacgtcgtcgtt

SEQ ID NO: 1727 - RNA, 21 nt, synthetic construct
  source 1..21: mol_type = other RNA
gcctctggcagacgtcgtctt

SEQ ID NO: 1728 - RNA, 21 nt, synthetic construct
  source 1..21: mol_type = other RNA
ggcctctggcagacgtcgttt

SEQ ID NO: 1729 - RNA, 21 nt, synthetic construct
  source 1..21: mol_type = other RNA
gggcctctggcagacgtcgtt

SEQ ID NO: 1730 - RNA, 21 nt, synthetic construct
  source 1..21: mol_type = other RNA
agggcctctggcagacgtctt

SEQ ID NO: 1731 - RNA, 21 nt, synthetic construct
  source 1..21: mol_type = other RNA
tagggcctctggcagacgttt

SEQ ID NO: 1732 - RNA, 21 nt, synthetic construct
  source 1..21: mol_type = other RNA
gtagggcctctggcagacgtt

SEQ ID NO: 1733 - RNA, 21 nt, synthetic construct
  source 1..21: mol_type = other RNA
aggtggaaatggattggaatt

SEQ ID NO: 1734 - RNA, 21 nt, synthetic construct
  source 1..21: mol_type = other RNA
ggtagggcctctggcagactt

SEQ ID NO: 1735 - RNA, 21 nt, synthetic construct
  source 1..21: mol_type = other RNA
cggtagggcctctggcagatt

SEQ ID NO: 1736 - RNA, 21 nt, synthetic construct
  source 1..21: mol_type = other RNA
gcggtagggcctctggcagtt

SEQ ID NO: 1737 - RNA, 21 nt, synthetic construct
  source 1..21: mol_type = other RNA
agcggtagggcctctggcatt

SEQ ID NO: 1738 - RNA, 21 nt, synthetic construct
  source 1..21: mol_type = other RNA
cagcggtagggcctctggctt

SEQ ID NO: 1739 - RNA, 21 nt, synthetic construct
  source 1..21: mol_type = other RNA
ccagcggtagggcctctggtt

SEQ ID NO: 1740 - RNA, 21 nt, synthetic construct
  source 1..21: mol_type = other RNA
cccagcggtagggcctctgtt

SEQ ID NO: 1741 - RNA, 21 nt, synthetic construct
  source 1..21: mol_type = other RNA
acccagcggtagggcctcttt

SEQ ID NO: 1742 - RNA, 21 nt, synthetic construct
  source 1..21: mol_type = other RNA
gacccagcggtagggcctctt

SEQ ID NO: 1743 - RNA, 21 nt, synthetic construct
  source 1..21: mol_type = other RNA
agacccagcggtagggccttt

SEQ ID NO: 1744 - RNA, 21 nt, synthetic construct
  source 1..21: mol_type = other RNA
gaggtggaaatggattggatt

SEQ ID NO: 1745 - RNA, 21 nt, synthetic construct
  source 1..21: mol_type = other RNA
cagacccagcggtagggcctt

SEQ ID NO: 1746 - RNA, 21 nt, synthetic construct
  source 1..21: mol_type = other RNA
gcagacccagcggtagggctt

SEQ ID NO: 1747 - RNA, 21 nt, synthetic construct
  source 1..21: mol_type = other RNA
cgcagacccagcggtagggtt

SEQ ID NO: 1748 - RNA, 21 nt, synthetic construct
  source 1..21: mol_type = other RNA
tcgcagacccagcggtaggtt

SEQ ID NO: 1749 - RNA, 21 nt, synthetic construct
  source 1..21: mol_type = other RNA
ctcgcagacccagcggtagtt

SEQ ID NO: 1750 - RNA, 21 nt, synthetic construct
  source 1..21: mol_type = other RNA
tctcgcagacccagcggtatt

SEQ ID NO: 1751 - RNA, 21 nt, synthetic construct
  source 1..21: mol_type = other RNA
gtctcgcagacccagcggttt

SEQ ID NO: 1752 - RNA, 21 nt, synthetic construct
  source 1..21: mol_type = other RNA
tgtctcgcagacccagcggtt

SEQ ID NO: 1753 - RNA, 21 nt, synthetic construct
  source 1..21: mol_type = other RNA
ctgtctcgcagacccagcgtt

SEQ ID NO: 1754 - RNA, 21 nt, synthetic construct
  source 1..21: mol_type = other RNA
tctgtctcgcagacccagctt

SEQ ID NO: 1755 - RNA, 21 nt, synthetic construct
  source 1..21: mol_type = other RNA
agaggtggaaatggattggtt

SEQ ID NO: 1756 - RNA, 21 nt, synthetic construct
  source 1..21: mol_type = other RNA
ctctgtctcgcagacccagtt

SEQ ID NO: 1757 - RNA, 21 nt, synthetic construct
  source 1..21: mol_type = other RNA
gctctgtctcgcagacccatt

SEQ ID NO: 1758 - RNA, 21 nt, synthetic construct
  source 1..21: mol_type = other RNA
agctctgtctcgcagaccctt

SEQ ID NO: 1759 - RNA, 21 nt, synthetic construct
  source 1..21: mol_type = other RNA
cagctctgtctcgcagacctt

SEQ ID NO: 1760 - RNA, 21 nt, synthetic construct
  source 1..21: mol_type = other RNA
ccagctctgtctcgcagactt

SEQ ID NO: 1761 - RNA, 21 nt, synthetic construct
  source 1..21: mol_type = other RNA
tccagctctgtctcgcagatt

SEQ ID NO: 1762 - RNA, 21 nt, synthetic construct
  source 1..21: mol_type = other RNA
gtccagctctgtctcgcagtt

SEQ ID NO: 1763 - RNA, 21 nt, synthetic construct
  source 1..21: mol_type = other RNA
tgtccagctctgtctcgcatt

SEQ ID NO: 1764 - RNA, 21 nt, synthetic construct
  source 1..21: mol_type = other RNA
gtcacctcactcttccgtgtt

SEQ ID NO: 1765 - RNA, 21 nt, synthetic construct
  source 1..21: mol_type = other RNA
ttgtccagctctgtctcgctt

SEQ ID NO: 1766 - RNA, 21 nt, synthetic construct
  source 1..21: mol_type = other RNA
cttgtccagctctgtctcgtt

SEQ ID NO: 1767 - RNA, 21 nt, synthetic construct
  source 1..21: mol_type = other RNA
cagaggtggaaatggattgtt

SEQ ID NO: 1768 - RNA, 21 nt, synthetic construct
  source 1..21: mol_type = other RNA
ccttgtccagctctgtctctt

SEQ ID NO: 1769 - RNA, 21 nt, synthetic construct
  source 1..21: mol_type = other RNA
gccttgtccagctctgtcttt

SEQ ID NO: 1770 - RNA, 21 nt, synthetic construct
  source 1..21: mol_type = other RNA
ggccttgtccagctctgtctt

SEQ ID NO: 1771 - RNA, 21 nt, synthetic construct
  source 1..21: mol_type = other RNA
tggccttgtccagctctgttt

SEQ ID NO: 1772 - RNA, 21 nt, synthetic construct
  source 1..21: mol_type = other RNA
ctggccttgtccagctctgtt

SEQ ID NO: 1773 - RNA, 21 nt, synthetic construct
  source 1..21: mol_type = other RNA
gctggccttgtccagctcttt

SEQ ID NO: 1774 - RNA, 21 nt, synthetic construct
  source 1..21: mol_type = other RNA
ggctggccttgtccagctctt

SEQ ID NO: 1775 - RNA, 21 nt, synthetic construct
  source 1..21: mol_type = other RNA
tggctggccttgtccagcttt

SEQ ID NO: 1776 - RNA, 21 nt, synthetic construct
  source 1..21: mol_type = other RNA
ctggctggccttgtccagctt

SEQ ID NO: 1777 - RNA, 21 nt, synthetic construct
  source 1..21: mol_type = other RNA
cctggctggccttgtccagtt

SEQ ID NO: 1778 - RNA, 21 nt, synthetic construct
  source 1..21: mol_type = other RNA
acagaggtggaaatggatttt

SEQ ID NO: 1779 - RNA, 21 nt, synthetic construct
  source 1..21: mol_type = other RNA
tcctggctggccttgtccatt

SEQ ID NO: 1780 - RNA, 21 nt, synthetic construct
  source 1..21: mol_type = other RNA
ctcctggctggccttgtcctt

SEQ ID NO: 1781 - RNA, 21 nt, synthetic construct
  source 1..21: mol_type = other RNA
gctcctggctggccttgtctt

SEQ ID NO: 1782 - RNA, 21 nt, synthetic construct
  source 1..21: mol_type = other RNA
ggctcctggctggccttgttt

SEQ ID NO: 1783 - RNA, 21 nt, synthetic construct
  source 1..21: mol_type = other RNA
tggctcctggctggccttgtt

SEQ ID NO: 1784 - RNA, 21 nt, synthetic construct
  source 1..21: mol_type = other RNA
gtggctcctggctggcctttt

SEQ ID NO: 1785 - RNA, 21 nt, synthetic construct
  source 1..21: mol_type = other RNA
ggtggctcctggctggccttt

SEQ ID NO: 1786 - RNA, 21 nt, synthetic construct
  source 1..21: mol_type = other RNA
aggtggctcctggctggcctt

SEQ ID NO: 1787 - RNA, 21 nt, synthetic construct
  source 1..21: mol_type = other RNA
gaggtggctcctggctggctt

SEQ ID NO: 1788 - RNA, 21 nt, synthetic construct
  source 1..21: mol_type = other RNA
agaggtggctcctggctggtt

SEQ ID NO: 1789 - RNA, 21 nt, synthetic construct
  source 1..21: mol_type = other RNA
aacagaggtggaaatggattt

SEQ ID NO: 1790 - RNA, 21 nt, synthetic construct
  source 1..21: mol_type = other RNA
gagaggtggctcctggctgtt

SEQ ID NO: 1791 - RNA, 21 nt, synthetic construct
  source 1..21: mol_type = other RNA
ggagaggtggctcctggcttt

SEQ ID NO: 1792 - RNA, 21 nt, synthetic construct
  source 1..21: mol_type = other RNA
aggagaggtggctcctggctt

SEQ ID NO: 1793 - RNA, 21 nt, synthetic construct
  source 1..21: mol_type = other RNA
aaggagaggtggctcctggtt

SEQ ID NO: 1794 - RNA, 21 nt, synthetic construct
  source 1..21: mol_type = other RNA
aaaggagaggtggctcctgtt

SEQ ID NO: 1795 - RNA, 21 nt, synthetic construct
  source 1..21: mol_type = other RNA
taaaggagaggtggctccttt

SEQ ID NO: 1796 - RNA, 21 nt, synthetic construct
  source 1..21: mol_type = other RNA
ttaaaggagaggtggctcctt

SEQ ID NO: 1797 - RNA, 21 nt, synthetic construct
  source 1..21: mol_type = other RNA
attaaaggagaggtggctctt

SEQ ID NO: 1798 - RNA, 21 nt, synthetic construct
  source 1..21: mol_type = other RNA
aattaaaggagaggtggcttt

SEQ ID NO: 1799 - RNA, 21 nt, synthetic construct
  source 1..21: mol_type = other RNA
aaattaaaggagaggtggctt

SEQ ID NO: 1800 - RNA, 21 nt, synthetic construct
  source 1..21: mol_type = other RNA
aaacagaggtggaaatggatt

SEQ ID NO: 1801 - RNA, 21 nt, synthetic construct
  source 1..21: mol_type = other RNA
taaattaaaggagaggtggtt

SEQ ID NO: 1802 - RNA, 21 nt, synthetic construct
  source 1..21: mol_type = other RNA
ataaattaaaggagaggtgtt

SEQ ID NO: 1803 - RNA, 21 nt, synthetic construct
  source 1..21: mol_type = other RNA
aataaattaaaggagaggttt

SEQ ID NO: 1804 - RNA, 21 nt, synthetic construct
  source 1..21: mol_type = other RNA
aaataaattaaaggagaggtt

SEQ ID NO: 1805 - RNA, 21 nt, synthetic construct
  source 1..21: mol_type = other RNA
gaaataaattaaaggagagtt

SEQ ID NO: 1806 - RNA, 21 nt, synthetic construct
  source 1..21: mol_type = other RNA
agaaataaattaaaggagatt

SEQ ID NO: 1807 - RNA, 21 nt, synthetic construct
  source 1..21: mol_type = other RNA
aagaaataaattaaaggagtt

SEQ ID NO: 1808 - RNA, 21 nt, synthetic construct
  source 1..21: mol_type = other RNA
gaagaaataaattaaaggatt

SEQ ID NO: 1809 - RNA, 21 nt, synthetic construct
  source 1..21: mol_type = other RNA
tgaagaaataaattaaaggtt

SEQ ID NO: 1810 - RNA, 21 nt, synthetic construct
  source 1..21: mol_type = other RNA
ttgaagaaataaattaaagtt

SEQ ID NO: 1811 - RNA, 21 nt, synthetic construct
  source 1..21: mol_type = other RNA
taaacagaggtggaaatggtt

SEQ ID NO: 1812 - RNA, 21 nt, synthetic construct
  source 1..21: mol_type = other RNA
attgaagaaataaattaaatt

SEQ ID NO: 1813 - RNA, 21 nt, synthetic construct
  source 1..21: mol_type = other RNA
cattgaagaaataaattaatt

SEQ ID NO: 1814 - RNA, 21 nt, synthetic construct
  source 1..21: mol_type = other RNA
gcattgaagaaataaattatt

SEQ ID NO: 1815 - RNA, 21 nt, synthetic construct
  source 1..21: mol_type = other RNA
ggcattgaagaaataaatttt

SEQ ID NO: 1816 - RNA, 21 nt, synthetic construct
  source 1..21: mol_type = other RNA
aggcattgaagaaataaattt

SEQ ID NO: 1817 - RNA, 21 nt, synthetic construct
  source 1..21: mol_type = other RNA
gaggcattgaagaaataaatt

SEQ ID NO: 1818 - RNA, 21 nt, synthetic construct
  source 1..21: mol_type = other RNA
cgaggcattgaagaaataatt

SEQ ID NO: 1819 - RNA, 21 nt, synthetic construct
  source 1..21: mol_type = other RNA
tcgaggcattgaagaaatatt

SEQ ID NO: 1820 - RNA, 21 nt, synthetic construct
  source 1..21: mol_type = other RNA
gtcgaggcattgaagaaattt

SEQ ID NO: 1821 - RNA, 21 nt, synthetic construct
  source 1..21: mol_type = other RNA
ggtcgaggcattgaagaaatt

SEQ ID NO: 1822 - RNA, 21 nt, synthetic construct
  source 1..21: mol_type = other RNA
gtaaacagaggtggaaatgtt

SEQ ID NO: 1823 - RNA, 21 nt, synthetic construct
  source 1..21: mol_type = other RNA
aggtcgaggcattgaagaatt

SEQ ID NO: 1824 - RNA, 21 nt, synthetic construct
  source 1..21: mol_type = other RNA
caggtcgaggcattgaagatt

SEQ ID NO: 1825 - RNA, 21 nt, synthetic construct
  source 1..21: mol_type = other RNA
gcaggtcgaggcattgaagtt

SEQ ID NO: 1826 - RNA, 21 nt, synthetic construct
  source 1..21: mol_type = other RNA
ggcaggtcgaggcattgaatt

SEQ ID NO: 1827 - RNA, 21 nt, synthetic construct
  source 1..21: mol_type = other RNA
cggcaggtcgaggcattgatt

SEQ ID NO: 1828 - RNA, 21 nt, synthetic construct
  source 1..21: mol_type = other RNA
gcggcaggtcgaggcattgtt

SEQ ID NO: 1829 - RNA, 21 nt, synthetic construct
  source 1..21: mol_type = other RNA
tgcggcaggtcgaggcatttt

SEQ ID NO: 1830 - RNA, 21 nt, synthetic construct
  source 1..21: mol_type = other RNA
ctgcggcaggtcgaggcattt

SEQ ID NO: 1831 - RNA, 21 nt, synthetic construct
  source 1..21: mol_type = other RNA
cctgcggcaggtcgaggcatt

SEQ ID NO: 1832 - RNA, 21 nt, synthetic construct
  source 1..21: mol_type = other RNA
ccctgcggcaggtcgaggctt

SEQ ID NO: 1833 - RNA, 21 nt, synthetic construct
  source 1..21: mol_type = other RNA
agtaaacagaggtggaaattt

SEQ ID NO: 1834 - RNA, 21 nt, synthetic construct
  source 1..21: mol_type = other RNA
cccctgcggcaggtcgaggtt

SEQ ID NO: 1835 - RNA, 21 nt, synthetic construct
  source 1..21: mol_type = other RNA
acccctgcggcaggtcgagtt

SEQ ID NO: 1836 - RNA, 21 nt, synthetic construct
  source 1..21: mol_type = other RNA
gacccctgcggcaggtcgatt

SEQ ID NO: 1837 - RNA, 21 nt, synthetic construct
  source 1..21: mol_type = other RNA
ggacccctgcggcaggtcgtt

SEQ ID NO: 1838 - RNA, 21 nt, synthetic construct
  source 1..21: mol_type = other RNA
cggacccctgcggcaggtctt

SEQ ID NO: 1839 - RNA, 21 nt, synthetic construct
  source 1..21: mol_type = other RNA
ccggacccctgcggcaggttt

SEQ ID NO: 1840 - RNA, 21 nt, synthetic construct
  source 1..21: mol_type = other RNA
cccggacccctgcggcaggtt

SEQ ID NO: 1841 - RNA, 21 nt, synthetic construct
  source 1..21: mol_type = other RNA
tcccggacccctgcggcagtt

SEQ ID NO: 1842 - RNA, 21 nt, synthetic construct
  source 1..21: mol_type = other RNA
atcccggacccctgcggcatt

SEQ ID NO: 1843 - RNA, 21 nt, synthetic construct
  source 1..21: mol_type = other RNA
aatcccggacccctgcggctt

SEQ ID NO: 1844 - RNA, 21 nt, synthetic construct
  source 1..21: mol_type = other RNA
cagtaaacagaggtggaaatt

SEQ ID NO: 1845 - RNA, 21 nt, synthetic construct
  source 1..21: mol_type = other RNA
caatcccggacccctgcggtt

SEQ ID NO: 1846 - RNA, 21 nt, synthetic construct
  source 1..21: mol_type = other RNA
ccaatcccggacccctgcgtt

SEQ ID NO: 1847 - RNA, 21 nt, synthetic construct
  source 1..21: mol_type = other RNA
cccaatcccggacccctgctt

SEQ ID NO: 1848 - RNA, 21 nt, synthetic construct
  source 1..21: mol_type = other RNA
tcccaatcccggacccctgtt

SEQ ID NO: 1849 - RNA, 21 nt, synthetic construct
  source 1..21: mol_type = other RNA
ttcccaatcccggaccccttt

SEQ ID NO: 1850 - RNA, 21 nt, synthetic construct
  source 1..21: mol_type = other RNA
attcccaatcccggacccctt

SEQ ID NO: 1851 - RNA, 21 nt, synthetic construct
  source 1..21: mol_type = other RNA
gattcccaatcccggaccctt

SEQ ID NO: 1852 - RNA, 21 nt, synthetic construct
  source 1..21: mol_type = other RNA
ggattcccaatcccggacctt

SEQ ID NO: 1853 - RNA, 21 nt, synthetic construct
  source 1..21: mol_type = other RNA
cggattcccaatcccggactt

SEQ ID NO: 1854 - RNA, 21 nt, synthetic construct
  source 1..21: mol_type = other RNA
gcggattcccaatcccggatt

SEQ ID NO: 1855 - RNA, 21 nt, synthetic construct
  source 1..21: mol_type = other RNA
acagtaaacagaggtggaatt

SEQ ID NO: 1856 - RNA, 21 nt, synthetic construct
  source 1..21: mol_type = other RNA
ggcggattcccaatcccggtt

SEQ ID NO: 1857 - RNA, 21 nt, synthetic construct
  source 1..21: mol_type = other RNA
gggcggattcccaatcccgtt

SEQ ID NO: 1858 - RNA, 21 nt, synthetic construct
  source 1..21: mol_type = other RNA
tgggcggattcccaatccctt

SEQ ID NO: 1859 - RNA, 21 nt, synthetic construct
  source 1..21: mol_type = other RNA
atgggcggattcccaatcctt

SEQ ID NO: 1860 - RNA, 21 nt, synthetic construct
  source 1..21: mol_type = other RNA
gatgggcggattcccaatctt

SEQ ID NO: 1861 - RNA, 21 nt, synthetic construct
  source 1..21: mol_type = other RNA
agatgggcggattcccaattt

SEQ ID NO: 1862 - RNA, 21 nt, synthetic construct
  source 1..21: mol_type = other RNA
cagatgggcggattcccaatt

SEQ ID NO: 1863 - RNA, 21 nt, synthetic construct
  source 1..21: mol_type = other RNA
ccagatgggcggattcccatt

SEQ ID NO: 1864 - RNA, 21 nt, synthetic construct
  source 1..21: mol_type = other RNA
cccagatgggcggattccctt

SEQ ID NO: 1865 - RNA, 21 nt, synthetic construct
  source 1..21: mol_type = other RNA
ccccagatgggcggattcctt

SEQ ID NO: 1866 - RNA, 21 nt, synthetic construct
  source 1..21: mol_type = other RNA
gacagtaaacagaggtggatt

SEQ ID NO: 1867 - RNA, 21 nt, synthetic construct
  source 1..21: mol_type = other RNA
cccccagatgggcggattctt

SEQ ID NO: 1868 - RNA, 21 nt, synthetic construct
  source 1..21: mol_type = other RNA
gcccccagatgggcggatttt

SEQ ID NO: 1869 - RNA, 21 nt, synthetic construct
  source 1..21: mol_type = other RNA
ggcccccagatgggcggattt

SEQ ID NO: 1870 - RNA, 21 nt, synthetic construct
  source 1..21: mol_type = other RNA
aggcccccagatgggcggatt

SEQ ID NO: 1871 - RNA, 21 nt, synthetic construct
  source 1..21: mol_type = other RNA
gaggcccccagatgggcggtt

SEQ ID NO: 1872 - RNA, 21 nt, synthetic construct
  source 1..21: mol_type = other RNA
agaggcccccagatgggcgtt

SEQ ID NO: 1873 - RNA, 21 nt, synthetic construct
  source 1..21: mol_type = other RNA
aagaggcccccagatgggctt

SEQ ID NO: 1874 - RNA, 21 nt, synthetic construct
  source 1..21: mol_type = other RNA
gaagaggcccccagatgggtt

SEQ ID NO: 1875 - RNA, 21 nt, synthetic construct
  source 1..21: mol_type = other RNA
agaagaggcccccagatggtt

SEQ ID NO: 1876 - RNA, 21 nt, synthetic construct
  source 1..21: mol_type = other RNA
agtcacctcactcttccgttt

SEQ ID NO: 1877 - RNA, 21 nt, synthetic construct
  source 1..21: mol_type = other RNA
cagaagaggcccccagatgtt

SEQ ID NO: 1878 - RNA, 21 nt, synthetic construct
  source 1..21: mol_type = other RNA
ggacagtaaacagaggtggtt

SEQ ID NO: 1879 - RNA, 21 nt, synthetic construct
  source 1..21: mol_type = other RNA
gcagaagaggcccccagattt

SEQ ID NO: 1880 - RNA, 21 nt, synthetic construct
  source 1..21: mol_type = other RNA
agcagaagaggcccccagatt

SEQ ID NO: 1881 - RNA, 21 nt, synthetic construct
  source 1..21: mol_type = other RNA
aagcagaagaggcccccagtt

SEQ ID NO: 1882 - RNA, 21 nt, synthetic construct
  source 1..21: mol_type = other RNA
aaagcagaagaggcccccatt

SEQ ID NO: 1883 - RNA, 21 nt, synthetic construct
  source 1..21: mol_type = other RNA
gaaagcagaagaggccccctt

SEQ ID NO: 1884 - RNA, 21 nt, synthetic construct
  source 1..21: mol_type = other RNA
agaaagcagaagaggcccctt

SEQ ID NO: 1885 - RNA, 21 nt, synthetic construct
  source 1..21: mol_type = other RNA
gagaaagcagaagaggccctt

SEQ ID NO: 1886 - RNA, 21 nt, synthetic construct
  source 1..21: mol_type = other RNA
cgagaaagcagaagaggcctt

SEQ ID NO: 1887 - RNA, 21 nt, synthetic construct
  source 1..21: mol_type = other RNA
ccgagaaagcagaagaggctt

SEQ ID NO: 1888 - RNA, 21 nt, synthetic construct
  source 1..21: mol_type = other RNA
cccgagaaagcagaagaggtt

SEQ ID NO: 1889 - RNA, 21 nt, synthetic construct
  source 1..21: mol_type = other RNA
tggacagtaaacagaggtgtt

SEQ ID NO: 1890 - RNA, 21 nt, synthetic construct
  source 1..21: mol_type = other RNA
tcccgagaaagcagaagagtt

SEQ ID NO: 1891 - RNA, 21 nt, synthetic construct
  source 1..21: mol_type = other RNA
ttcccgagaaagcagaagatt

SEQ ID NO: 1892 - RNA, 21 nt, synthetic construct
  source 1..21: mol_type = other RNA
attcccgagaaagcagaagtt

SEQ ID NO: 1893 - RNA, 21 nt, synthetic construct
  source 1..21: mol_type = other RNA
aattcccgagaaagcagaatt

SEQ ID NO: 1894 - RNA, 21 nt, synthetic construct
  source 1..21: mol_type = other RNA
aaattcccgagaaagcagatt

SEQ ID NO: 1895 - RNA, 21 nt, synthetic construct
  source 1..21: mol_type = other RNA
aaaattcccgagaaagcagtt

SEQ ID NO: 1896 - RNA, 21 nt, synthetic construct
  source 1..21: mol_type = other RNA
gaaaattcccgagaaagcatt

SEQ ID NO: 1897 - RNA, 21 nt, synthetic construct
  source 1..21: mol_type = other RNA
tgaaaattcccgagaaagctt

SEQ ID NO: 1898 - RNA, 21 nt, synthetic construct
  source 1..21: mol_type = other RNA
atgaaaattcccgagaaagtt

SEQ ID NO: 1899 - RNA, 21 nt, synthetic construct
  source 1..21: mol_type = other RNA
gatgaaaattcccgagaaatt

SEQ ID NO: 1900 - RNA, 21 nt, synthetic construct
  source 1..21: mol_type = other RNA
ttggacagtaaacagaggttt

SEQ ID NO: 1901 - RNA, 21 nt, synthetic construct
  source 1..21: mol_type = other RNA
agatgaaaattcccgagaatt

SEQ ID NO: 1902 - RNA, 21 nt, synthetic construct
  source 1..21: mol_type = other RNA
tagatgaaaattcccgagatt

SEQ ID NO: 1903 - RNA, 21 nt, synthetic construct
  source 1..21: mol_type = other RNA
ctagatgaaaattcccgagtt

SEQ ID NO: 1904 - RNA, 21 nt, synthetic construct
  source 1..21: mol_type = other RNA
cctagatgaaaattcccgatt

SEQ ID NO: 1905 - RNA, 21 nt, synthetic construct
  source 1..21: mol_type = other RNA
tcctagatgaaaattcccgtt

SEQ ID NO: 1906 - RNA, 21 nt, synthetic construct
  source 1..21: mol_type = other RNA
atcctagatgaaaattccctt

SEQ ID NO: 1907 - RNA, 21 nt, synthetic construct
  source 1..21: mol_type = other RNA
aatcctagatgaaaattcctt

SEQ ID NO: 1908 - RNA, 21 nt, synthetic construct
  source 1..21: mol_type = other RNA
aaatcctagatgaaaattctt

SEQ ID NO: 1909 - RNA, 21 nt, synthetic construct
  source 1..21: mol_type = other RNA
aaaatcctagatgaaaatttt

SEQ ID NO: 1910 - RNA, 21 nt, synthetic construct
  source 1..21: mol_type = other RNA
taaaatcctagatgaaaattt

SEQ ID NO: 1911 - RNA, 21 nt, synthetic construct
  source 1..21: mol_type = other RNA
tttggacagtaaacagaggtt

SEQ ID NO: 1912 - RNA, 21 nt, synthetic construct
  source 1..21: mol_type = other RNA
ttaaaatcctagatgaaaatt

SEQ ID NO: 1913 - RNA, 21 nt, synthetic construct
  source 1..21: mol_type = other RNA
cttaaaatcctagatgaaatt

SEQ ID NO: 1914 - RNA, 21 nt, synthetic construct
  source 1..21: mol_type = other RNA
ccttaaaatcctagatgaatt

SEQ ID NO: 1915 - RNA, 21 nt, synthetic construct
  source 1..21: mol_type = other RNA
cccttaaaatcctagatgatt

SEQ ID NO: 1916 - RNA, 21 nt, synthetic construct
  source 1..21: mol_type = other RNA
tcccttaaaatcctagatgtt

SEQ ID NO: 1917 - RNA, 21 nt, synthetic construct
  source 1..21: mol_type = other RNA
ttcccttaaaatcctagattt

SEQ ID NO: 1918 - RNA, 21 nt, synthetic construct
  source 1..21: mol_type = other RNA
cttcccttaaaatcctagatt

SEQ ID NO: 1919 - RNA, 21 nt, synthetic construct
  source 1..21: mol_type = other RNA
ccttcccttaaaatcctagtt

SEQ ID NO: 1920 - RNA, 21 nt, synthetic construct
  source 1..21: mol_type = other RNA
cccttcccttaaaatcctatt

SEQ ID NO: 1921 - RNA, 21 nt, synthetic construct
  source 1..21: mol_type = other RNA
ccccttcccttaaaatccttt

SEQ ID NO: 1922 - RNA, 21 nt, synthetic construct
  source 1..21: mol_type = other RNA
ctttggacagtaaacagagtt

SEQ ID NO: 1923 - RNA, 21 nt, synthetic construct
  source 1..21: mol_type = other RNA
tccccttcccttaaaatcctt

SEQ ID NO: 1924 - RNA, 21 nt, synthetic construct
  source 1..21: mol_type = other RNA
ttccccttcccttaaaatctt

SEQ ID NO: 1925 - RNA, 21 nt, synthetic construct
  source 1..21: mol_type = other RNA
cttccccttcccttaaaattt

SEQ ID NO: 1926 - RNA, 21 nt, synthetic construct
  source 1..21: mol_type = other RNA
ccttccccttcccttaaaatt

SEQ ID NO: 1927 - RNA, 21 nt, synthetic construct
  source 1..21: mol_type = other RNA
tccttccccttcccttaaatt

SEQ ID NO: 1928 - RNA, 21 nt, synthetic construct
  source 1..21: mol_type = other RNA
atccttccccttcccttaatt

SEQ ID NO: 1929 - RNA, 21 nt, synthetic construct
  source 1..21: mol_type = other RNA
tatccttccccttcccttatt

SEQ ID NO: 1930 - RNA, 21 nt, synthetic construct
  source 1..21: mol_type = other RNA
ctatccttccccttccctttt

SEQ ID NO: 1931 - RNA, 21 nt, synthetic construct
  source 1..21: mol_type = other RNA
cctatccttccccttcccttt

SEQ ID NO: 1932 - RNA, 21 nt, synthetic construct
  source 1..21: mol_type = other RNA
ccctatccttccccttccctt

SEQ ID NO: 1933 - RNA, 21 nt, synthetic construct
  source 1..21: mol_type = other RNA
actttggacagtaaacagatt

SEQ ID NO: 1934 - RNA, 21 nt, synthetic construct
  source 1..21: mol_type = other RNA
accctatccttccccttcctt

SEQ ID NO: 1935 - RNA, 21 nt, synthetic construct
  source 1..21: mol_type = other RNA
caccctatccttccccttctt

SEQ ID NO: 1936 - RNA, 21 nt, synthetic construct
  source 1..21: mol_type = other RNA
tcaccctatccttcccctttt

SEQ ID NO: 1937 - RNA, 21 nt, synthetic construct
  source 1..21: mol_type = other RNA
atcaccctatccttccccttt

SEQ ID NO: 1938 - RNA, 21 nt, synthetic construct
  source 1..21: mol_type = other RNA
catcaccctatccttcccctt

SEQ ID NO: 1939 - RNA, 21 nt, synthetic construct
  source 1..21: mol_type = other RNA
acatcaccctatccttccctt

SEQ ID NO: 1940 - RNA, 21 nt, synthetic construct
  source 1..21: mol_type = other RNA
aacatcaccctatccttcctt

SEQ ID NO: 1941 - RNA, 21 nt, synthetic construct
  source 1..21: mol_type = other RNA
gaacatcaccctatccttctt

SEQ ID NO: 1942 - RNA, 21 nt, synthetic construct
  source 1..21: mol_type = other RNA
ggaacatcaccctatcctttt

SEQ ID NO: 1943 - RNA, 21 nt, synthetic construct
  source 1..21: mol_type = other RNA
cggaacatcaccctatccttt

SEQ ID NO: 1944 - RNA, 21 nt, synthetic construct
  source 1..21: mol_type = other RNA
gactttggacagtaaacagtt

SEQ ID NO: 1945 - RNA, 21 nt, synthetic construct
  source 1..21: mol_type = other RNA
tcggaacatcaccctatcctt

SEQ ID NO: 1946 - RNA, 21 nt, synthetic construct
  source 1..21: mol_type = other RNA
ttcggaacatcaccctatctt

SEQ ID NO: 1947 - RNA, 21 nt, synthetic construct
  source 1..21: mol_type = other RNA
cttcggaacatcaccctattt

SEQ ID NO: 1948 - RNA, 21 nt, synthetic construct
  source 1..21: mol_type = other RNA
ccttcggaacatcaccctatt

SEQ ID NO: 1949 - RNA, 21 nt, synthetic construct
  source 1..21: mol_type = other RNA
accttcggaacatcacccttt

SEQ ID NO: 1950 - RNA, 21 nt, synthetic construct
  source 1..21: mol_type = other RNA
caccttcggaacatcaccctt

SEQ ID NO: 1951 - RNA, 21 nt, synthetic construct
  source 1..21: mol_type = other RNA
tcaccttcggaacatcacctt

SEQ ID NO: 1952 - RNA, 21 nt, synthetic construct
  source 1..21: mol_type = other RNA
ctcaccttcggaacatcactt

SEQ ID NO: 1953 - RNA, 21 nt, synthetic construct
  source 1..21: mol_type = other RNA
cctcaccttcggaacatcatt

SEQ ID NO: 1954 - RNA, 21 nt, synthetic construct
  source 1..21: mol_type = other RNA
tcctcaccttcggaacatctt

SEQ ID NO: 1955 - RNA, 21 nt, synthetic construct
  source 1..21: mol_type = other RNA
ggactttggacagtaaacatt

SEQ ID NO: 1956 - RNA, 21 nt, synthetic construct
  source 1..21: mol_type = other RNA
ctcctcaccttcggaacattt

SEQ ID NO: 1957 - RNA, 21 nt, synthetic construct
  source 1..21: mol_type = other RNA
gctcctcaccttcggaacatt

SEQ ID NO: 1958 - RNA, 21 nt, synthetic construct
  source 1..21: mol_type = other RNA
agctcctcaccttcggaactt

SEQ ID NO: 1959 - RNA, 21 nt, synthetic construct
  source 1..21: mol_type = other RNA
aagctcctcaccttcggaatt

SEQ ID NO: 1960 - RNA, 21 nt, synthetic construct
  source 1..21: mol_type = other RNA
caagctcctcaccttcggatt

SEQ ID NO: 1961 - RNA, 21 nt, synthetic construct
  source 1..21: mol_type = other RNA
tcaagctcctcaccttcggtt

SEQ ID NO: 1962 - RNA, 21 nt, synthetic construct
  source 1..21: mol_type = other RNA
ttcaagctcctcaccttcgtt

SEQ ID NO: 1963 - RNA, 21 nt, synthetic construct
  source 1..21: mol_type = other RNA
tttcaagctcctcaccttctt

SEQ ID NO: 1964 - RNA, 21 nt, synthetic construct
  source 1..21: mol_type = other RNA
gtttcaagctcctcacctttt

SEQ ID NO: 1965 - RNA, 21 nt, synthetic construct
  source 1..21: mol_type = other RNA
ggtttcaagctcctcaccttt

SEQ ID NO: 1966 - RNA, 21 nt, synthetic construct
  source 1..21: mol_type = other RNA
gggactttggacagtaaactt

SEQ ID NO: 1967 - RNA, 21 nt, synthetic construct
  source 1..21: mol_type = other RNA
gggtttcaagctcctcacctt

SEQ ID NO: 1968 - RNA, 21 nt, synthetic construct
  source 1..21: mol_type = other RNA
cgggtttcaagctcctcactt

SEQ ID NO: 1969 - RNA, 21 nt, synthetic construct
  source 1..21: mol_type = other RNA
acgggtttcaagctcctcatt

SEQ ID NO: 1970 - RNA, 21 nt, synthetic construct
  source 1..21: mol_type = other RNA
cacgggtttcaagctcctctt

SEQ ID NO: 1971 - RNA, 21 nt, synthetic construct
  source 1..21: mol_type = other RNA
ccacgggtttcaagctccttt

SEQ ID NO: 1972 - RNA, 21 nt, synthetic construct
  source 1..21: mol_type = other RNA
gccacgggtttcaagctcctt

SEQ ID NO: 1973 - RNA, 21 nt, synthetic construct
  source 1..21: mol_type = other RNA
cgccacgggtttcaagctctt

SEQ ID NO: 1974 - RNA, 21 nt, synthetic construct
  source 1..21: mol_type = other RNA
gcgccacgggtttcaagcttt

SEQ ID NO: 1975 - RNA, 21 nt, synthetic construct
  source 1..21: mol_type = other RNA
agcgccacgggtttcaagctt

SEQ ID NO: 1976 - RNA, 21 nt, synthetic construct
  source 1..21: mol_type = other RNA
aagcgccacgggtttcaagtt

SEQ ID NO: 1977 - RNA, 21 nt, synthetic construct
  source 1..21: mol_type = other RNA
cgggactttggacagtaaatt

SEQ ID NO: 1978 - RNA, 21 nt, synthetic construct
  source 1..21: mol_type = other RNA
aaagcgccacgggtttcaatt

SEQ ID NO: 1979 - RNA, 21 nt, synthetic construct
  source 1..21: mol_type = other RNA
gaaagcgccacgggtttcatt

SEQ ID NO: 1980 - RNA, 21 nt, synthetic construct
  source 1..21: mol_type = other RNA
agaaagcgccacgggtttctt

SEQ ID NO: 1981 - RNA, 21 nt, synthetic construct
  source 1..21: mol_type = other RNA
cagaaagcgccacgggttttt

SEQ ID NO: 1982 - RNA, 21 nt, synthetic construct
  source 1..21: mol_type = other RNA
gcagaaagcgccacgggtttt

SEQ ID NO: 1983 - RNA, 21 nt, synthetic construct
  source 1..21: mol_type = other RNA
tgcagaaagcgccacgggttt

SEQ ID NO: 1984 - RNA, 21 nt, synthetic construct
  source 1..21: mol_type = other RNA
ctgcagaaagcgccacgggtt

SEQ ID NO: 1985 - RNA, 21 nt, synthetic construct
  source 1..21: mol_type = other RNA
actgcagaaagcgccacggtt

SEQ ID NO: 1986 - RNA, 21 nt, synthetic construct
  source 1..21: mol_type = other RNA
aactgcagaaagcgccacgtt

SEQ ID NO: 1987 - RNA, 21 nt, synthetic construct
  source 1..21: mol_type = other RNA
aaactgcagaaagcgccactt

SEQ ID NO: 1988 - RNA, 21 nt, synthetic construct
  source 1..21: mol_type = other RNA
ccgggactttggacagtaatt

SEQ ID NO: 1989 - RNA, 21 nt, synthetic construct
  source 1..21: mol_type = other RNA
cagtcacctcactcttccgtt

SEQ ID NO: 1990 - RNA, 21 nt, synthetic construct
  source 1..21: mol_type = other RNA
caaactgcagaaagcgccatt

SEQ ID NO: 1991 - RNA, 21 nt, synthetic construct
  source 1..21: mol_type = other RNA
gcaaactgcagaaagcgcctt

SEQ ID NO: 1992 - RNA, 21 nt, synthetic construct
  source 1..21: mol_type = other RNA
tgcaaactgcagaaagcgctt

SEQ ID NO: 1993 - RNA, 21 nt, synthetic construct
  source 1..21: mol_type = other RNA
ctgcaaactgcagaaagcgtt

SEQ ID NO: 1994 - RNA, 21 nt, synthetic construct
  source 1..21: mol_type = other RNA
cctgcaaactgcagaaagctt

SEQ ID NO: 1995 - RNA, 21 nt, synthetic construct
  source 1..21: mol_type = other RNA
acctgcaaactgcagaaagtt

SEQ ID NO: 1996 - RNA, 21 nt, synthetic construct
  source 1..21: mol_type = other RNA
aacctgcaaactgcagaaatt

SEQ ID NO: 1997 - RNA, 21 nt, synthetic construct
  source 1..21: mol_type = other RNA
taacctgcaaactgcagaatt

SEQ ID NO: 1998 - RNA, 21 nt, synthetic construct
  source 1..21: mol_type = other RNA
ataacctgcaaactgcagatt

SEQ ID NO: 1999 - RNA, 21 nt, synthetic construct
  source 1..21: mol_type = other RNA
gataacctgcaaactgcagtt

SEQ ID NO: 2000 - RNA, 21 nt, synthetic construct
  source 1..21: mol_type = other RNA
cccgggactttggacagtatt

SEQ ID NO: 2001 - RNA, 21 nt, synthetic construct
  source 1..21: mol_type = other RNA
tgataacctgcaaactgcatt

SEQ ID NO: 2002 - RNA, 21 nt, synthetic construct
  source 1..21: mol_type = other RNA
atgataacctgcaaactgctt

SEQ ID NO: 2003 - RNA, 21 nt, synthetic construct
  source 1..21: mol_type = other RNA
aatgataacctgcaaactgtt

SEQ ID NO: 2004 - RNA, 21 nt, synthetic construct
  source 1..21: mol_type = other RNA
caatgataacctgcaaacttt

SEQ ID NO: 2005 - RNA, 21 nt, synthetic construct
  source 1..21: mol_type = other RNA
acaatgataacctgcaaactt

SEQ ID NO: 2006 - RNA, 21 nt, synthetic construct
  source 1..21: mol_type = other RNA
cacaatgataacctgcaaatt

SEQ ID NO: 2007 - RNA, 21 nt, synthetic construct
  source 1..21: mol_type = other RNA
tcacaatgataacctgcaatt

SEQ ID NO: 2008 - RNA, 21 nt, synthetic construct
  source 1..21: mol_type = other RNA
ttcacaatgataacctgcatt

SEQ ID NO: 2009 - RNA, 21 nt, synthetic construct
  source 1..21: mol_type = other RNA
gttcacaatgataacctgctt

SEQ ID NO: 2010 - RNA, 21 nt, synthetic construct
  source 1..21: mol_type = other RNA
agttcacaatgataacctgtt

SEQ ID NO: 2011 - RNA, 21 nt, synthetic construct
  source 1..21: mol_type = other RNA
gcccgggactttggacagttt

SEQ ID NO: 2012 - RNA, 21 nt, synthetic construct
  source 1..21: mol_type = other RNA
aagttcacaatgataaccttt

SEQ ID NO: 2013 - RNA, 21 nt, synthetic construct
  source 1..21: mol_type = other RNA
aaagttcacaatgataacctt

SEQ ID NO: 2014 - RNA, 21 nt, synthetic construct
  source 1..21: mol_type = other RNA
aaaagttcacaatgataactt

SEQ ID NO: 2015 - RNA, 21 nt, synthetic construct
  source 1..21: mol_type = other RNA
aaaaagttcacaatgataatt

SEQ ID NO: 2016 - RNA, 21 nt, synthetic construct
  source 1..21: mol_type = other RNA
aaaaaagttcacaatgatatt

SEQ ID NO: 2017 - RNA, 21 nt, synthetic construct
  source 1..21: mol_type = other RNA
aaaaaaagttcacaatgattt

SEQ ID NO: 2018 - RNA, 21 nt, synthetic construct
  source 1..21: mol_type = other RNA
aaaaaaaagttcacaatgatt

SEQ ID NO: 2019 - RNA, 21 nt, synthetic construct
  source 1..21: mol_type = other RNA
aaaaaaaaagttcacaatgtt

SEQ ID NO: 2020 - RNA, 21 nt, synthetic construct
  source 1..21: mol_type = other RNA
aaaaaaaaaagttcacaattt

SEQ ID NO: 2021 - RNA, 21 nt, synthetic construct
  source 1..21: mol_type = other RNA
aaaaaaaaaaagttcacaatt

SEQ ID NO: 2022 - RNA, 21 nt, synthetic construct
  source 1..21: mol_type = other RNA
tgcccgggactttggacagtt

SEQ ID NO: 2023 - RNA, 21 nt, synthetic construct
  source 1..21: mol_type = other RNA
taaaaaaaaaaagttcacatt

SEQ ID NO: 2024 - RNA, 21 nt, synthetic construct
  source 1..21: mol_type = other RNA
ttaaaaaaaaaaagttcactt

SEQ ID NO: 2025 - RNA, 21 nt, synthetic construct
  source 1..21: mol_type = other RNA
cttaaaaaaaaaaagttcatt

SEQ ID NO: 2026 - RNA, 21 nt, synthetic construct
  source 1..21: mol_type = other RNA
tcttaaaaaaaaaaagttctt

SEQ ID NO: 2027 - RNA, 21 nt, synthetic construct
  source 1..21: mol_type = other RNA
ctcttaaaaaaaaaaagtttt

SEQ ID NO: 2028 - RNA, 21 nt, synthetic construct
  source 1..21: mol_type = other RNA
actcttaaaaaaaaaaagttt

SEQ ID NO: 2029 - RNA, 21 nt, synthetic construct
  source 1..21: mol_type = other RNA
tactcttaaaaaaaaaaagtt

SEQ ID NO: 2030 - RNA, 21 nt, synthetic construct
  source 1..21: mol_type = other RNA
ttactcttaaaaaaaaaaatt

SEQ ID NO: 2031 - RNA, 21 nt, synthetic construct
  source 1..21: mol_type = other RNA
tttactcttaaaaaaaaaatt

SEQ ID NO: 2032 - RNA, 21 nt, synthetic construct
  source 1..21: mol_type = other RNA
ttttactcttaaaaaaaaatt

SEQ ID NO: 2033 - RNA, 21 nt, synthetic construct
  source 1..21: mol_type = other RNA
gtgcccgggactttggacatt

SEQ ID NO: 2034 - RNA, 21 nt, synthetic construct
  source 1..21: mol_type = other RNA
tttttactcttaaaaaaaatt

SEQ ID NO: 2035 - RNA, 21 nt, synthetic construct
  source 1..21: mol_type = other RNA
ctttttactcttaaaaaaatt

SEQ ID NO: 2036 - RNA, 21 nt, synthetic construct
  source 1..21: mol_type = other RNA
tctttttactcttaaaaaatt

SEQ ID NO: 2037 - RNA, 21 nt, synthetic construct
  source 1..21: mol_type = other RNA
ttctttttactcttaaaaatt

SEQ ID NO: 2038 - RNA, 21 nt, synthetic construct
  source 1..21: mol_type = other RNA
tttctttttactcttaaaatt

SEQ ID NO: 2039 - RNA, 21 nt, synthetic construct
  source 1..21: mol_type = other RNA
atttctttttactcttaaatt

SEQ ID NO: 2040 - RNA, 21 nt, synthetic construct
  source 1..21: mol_type = other RNA
tatttctttttactcttaatt

SEQ ID NO: 2041 - RNA, 21 nt, synthetic construct
  source 1..21: mol_type = other RNA
atatttctttttactcttatt

SEQ ID NO: 2042 - RNA, 21 nt, synthetic construct
  source 1..21: mol_type = other RNA
tatatttctttttactctttt

SEQ ID NO: 2043 - RNA, 21 nt, synthetic construct
  source 1..21: mol_type = other RNA
gtatatttctttttactcttt

SEQ ID NO: 2044 - RNA, 21 nt, synthetic construct
  source 1..21: mol_type = other RNA
agtgcccgggactttggactt

SEQ ID NO: 2045 - RNA, 21 nt, synthetic construct
  source 1..21: mol_type = other RNA
ggtatatttctttttactctt

SEQ ID NO: 2046 - RNA, 21 nt, synthetic construct
  source 1..21: mol_type = other RNA
aggtatatttctttttacttt

SEQ ID NO: 2047 - RNA, 21 nt, synthetic construct
  source 1..21: mol_type = other RNA
taggtatatttctttttactt

SEQ ID NO: 2048 - RNA, 21 nt, synthetic construct
  source 1..21: mol_type = other RNA
ttaggtatatttctttttatt

SEQ ID NO: 2049 - RNA, 21 nt, synthetic construct
  source 1..21: mol_type = other RNA
cagtgcccgggactttggatt

SEQ ID NO: 2050 - RNA, 21 nt, synthetic construct
  source 1..21: mol_type = other RNA
ccagtgcccgggactttggtt

SEQ ID NO: 2051 - RNA, 21 nt, synthetic construct
  source 1..21: mol_type = other RNA
tccagtgcccgggactttgtt

SEQ ID NO: 2052 - RNA, 21 nt, synthetic construct
  source 1..21: mol_type = other RNA
ctccagtgcccgggacttttt

SEQ ID NO: 2053 - RNA, 21 nt, synthetic construct
  source 1..21: mol_type = other RNA
tctccagtgcccgggactttt

SEQ ID NO: 2054 - RNA, 21 nt, synthetic construct
  source 1..21: mol_type = other RNA
ccagtcacctcactcttcctt

SEQ ID NO: 2055 - RNA, 21 nt, synthetic construct
  source 1..21: mol_type = other RNA
atctccagtgcccgggacttt

SEQ ID NO: 2056 - RNA, 21 nt, synthetic construct
  source 1..21: mol_type = other RNA
catctccagtgcccgggactt

SEQ ID NO: 2057 - RNA, 21 nt, synthetic construct
  source 1..21: mol_type = other RNA
gcatctccagtgcccgggatt

SEQ ID NO: 2058 - RNA, 21 nt, synthetic construct
  source 1..21: mol_type = other RNA
ggcatctccagtgcccgggtt

SEQ ID NO: 2059 - RNA, 21 nt, synthetic construct
  source 1..21: mol_type = other RNA
tggcatctccagtgcccggtt

SEQ ID NO: 2060 - RNA, 21 nt, synthetic construct
  source 1..21: mol_type = other RNA
gtggcatctccagtgcccgtt

SEQ ID NO: 2061 - RNA, 21 nt, synthetic construct
  source 1..21: mol_type = other RNA
cgtggcatctccagtgccctt

SEQ ID NO: 2062 - RNA, 21 nt, synthetic construct
  source 1..21: mol_type = other RNA
acgtggcatctccagtgcctt

SEQ ID NO: 2063 - RNA, 21 nt, synthetic construct
  source 1..21: mol_type = other RNA
aacgtggcatctccagtgctt

SEQ ID NO: 2064 - RNA, 21 nt, synthetic construct
  source 1..21: mol_type = other RNA
aaacgtggcatctccagtgtt

SEQ ID NO: 2065 - RNA, 21 nt, synthetic construct
  source 1..21: mol_type = other RNA
gccagtcacctcactcttctt

SEQ ID NO: 2066 - RNA, 21 nt, synthetic construct
  source 1..21: mol_type = other RNA
caaacgtggcatctccagttt

SEQ ID NO: 2067 - RNA, 21 nt, synthetic construct
  source 1..21: mol_type = other RNA
ccaaacgtggcatctccagtt

SEQ ID NO: 2068 - RNA, 21 nt, synthetic construct
  source 1..21: mol_type = other RNA
gccaaacgtggcatctccatt

SEQ ID NO: 2069 - RNA, 21 nt, synthetic construct
  source 1..21: mol_type = other RNA
cgccaaacgtggcatctcctt

SEQ ID NO: 2070 - RNA, 21 nt, synthetic construct
  source 1..21: mol_type = other RNA
acgccaaacgtggcatctctt

SEQ ID NO: 2071 - RNA, 21 nt, synthetic construct
  source 1..21: mol_type = other RNA
cacgccaaacgtggcatcttt

SEQ ID NO: 2072 - RNA, 21 nt, synthetic construct
  source 1..21: mol_type = other RNA
gcacgccaaacgtggcatctt

SEQ ID NO: 2073 - RNA, 21 nt, synthetic construct
  source 1..21: mol_type = other RNA
agcacgccaaacgtggcattt

SEQ ID NO: 2074 - RNA, 21 nt, synthetic construct
  source 1..21: mol_type = other RNA
aagcacgccaaacgtggcatt

SEQ ID NO: 2075 - RNA, 21 nt, synthetic construct
  source 1..21: mol_type = other RNA
caagcacgccaaacgtggctt

SEQ ID NO: 2076 - RNA, 21 nt, synthetic construct
  source 1..21: mol_type = other RNA
tgccagtcacctcactctttt

SEQ ID NO: 2077 - RNA, 21 nt, synthetic construct
  source 1..21: mol_type = other RNA
ccaagcacgccaaacgtggtt

SEQ ID NO: 2078 - RNA, 21 nt, synthetic construct
  source 1..21: mol_type = other RNA
tccaagcacgccaaacgtgtt

SEQ ID NO: 2079 - RNA, 21 nt, synthetic construct
  source 1..21: mol_type = other RNA
gtccaagcacgccaaacgttt

SEQ ID NO: 2080 - RNA, 21 nt, synthetic construct
  source 1..21: mol_type = other RNA
tgtccaagcacgccaaacgtt

SEQ ID NO: 2081 - RNA, 21 nt, synthetic construct
  source 1..21: mol_type = other RNA
gtgtccaagcacgccaaactt

SEQ ID NO: 2082 - RNA, 21 nt, synthetic construct
  source 1..21: mol_type = other RNA
tgtgtccaagcacgccaaatt

SEQ ID NO: 2083 - RNA, 21 nt, synthetic construct
  source 1..21: mol_type = other RNA
gtgtgtccaagcacgccaatt

SEQ ID NO: 2084 - RNA, 21 nt, synthetic construct
  source 1..21: mol_type = other RNA
tgtgtgtccaagcacgccatt

SEQ ID NO: 2085 - RNA, 21 nt, synthetic construct
  source 1..21: mol_type = other RNA
ctgtgtgtccaagcacgcctt

SEQ ID NO: 2086 - RNA, 21 nt, synthetic construct
  source 1..21: mol_type = other RNA
tctgtgtgtccaagcacgctt

SEQ ID NO: 2087 - RNA, 21 nt, synthetic construct
  source 1..21: mol_type = other RNA
atgccagtcacctcactcttt

SEQ ID NO: 2088 - RNA, 21 nt, synthetic construct
  source 1..21: mol_type = other RNA
gtctgtgtgtccaagcacgtt

SEQ ID NO: 2089 - RNA, 21 nt, synthetic construct
  source 1..21: mol_type = other RNA
tgtctgtgtgtccaagcactt

SEQ ID NO: 2090 - RNA, 21 nt, synthetic construct
  source 1..21: mol_type = other RNA
gtgtctgtgtgtccaagcatt

SEQ ID NO: 2091 - RNA, 21 nt, synthetic construct
  source 1..21: mol_type = other RNA
cgtgtctgtgtgtccaagctt

SEQ ID NO: 2092 - RNA, 21 nt, synthetic construct
  source 1..21: mol_type = other RNA
gcgtgtctgtgtgtccaagtt

SEQ ID NO: 2093 - RNA, 21 nt, synthetic construct
  source 1..21: mol_type = other RNA
tgcgtgtctgtgtgtccaatt

SEQ ID NO: 2094 - RNA, 21 nt, synthetic construct
  source 1..21: mol_type = other RNA
ctgcgtgtctgtgtgtccatt

SEQ ID NO: 2095 - RNA, 21 nt, synthetic construct
  source 1..21: mol_type = other RNA
tctgcgtgtctgtgtgtcctt

SEQ ID NO: 2096 - RNA, 21 nt, synthetic construct
  source 1..21: mol_type = other RNA
gtctgcgtgtctgtgtgtctt

SEQ ID NO: 2097 - RNA, 21 nt, synthetic construct
  source 1..21: mol_type = other RNA
tgtctgcgtgtctgtgtgttt

SEQ ID NO: 2098 - RNA, 21 nt, synthetic construct
  source 1..21: mol_type = other RNA
catgccagtcacctcactctt

SEQ ID NO: 2099 - RNA, 21 nt, synthetic construct
  source 1..21: mol_type = other RNA
gtgtctgcgtgtctgtgtgtt

SEQ ID NO: 2100 - RNA, 21 nt, synthetic construct
  source 1..21: mol_type = other RNA
tgtgtctgcgtgtctgtgttt

SEQ ID NO: 2101 - RNA, 21 nt, synthetic construct
  source 1..21: mol_type = other RNA
ctgtgtctgcgtgtctgtgtt

SEQ ID NO: 2102 - RNA, 21 nt, synthetic construct
  source 1..21: mol_type = other RNA
tctgtgtctgcgtgtctgttt

SEQ ID NO: 2103 - RNA, 21 nt, synthetic construct
  source 1..21: mol_type = other RNA
ctctgtgtctgcgtgtctgtt

SEQ ID NO: 2104 - RNA, 21 nt, synthetic construct
  source 1..21: mol_type = other RNA
tctctgtgtctgcgtgtcttt

SEQ ID NO: 2105 - RNA, 21 nt, synthetic construct
  source 1..21: mol_type = other RNA
gtctctgtgtctgcgtgtctt

SEQ ID NO: 2106 - RNA, 21 nt, synthetic construct
  source 1..21: mol_type = other RNA
tgtctctgtgtctgcgtgttt

SEQ ID NO: 2107 - RNA, 21 nt, synthetic construct
  source 1..21: mol_type = other RNA
gtgtctctgtgtctgcgtgtt

SEQ ID NO: 2108 - RNA, 21 nt, synthetic construct
  source 1..21: mol_type = other RNA
ggtgtctctgtgtctgcgttt

SEQ ID NO: 2109 - RNA, 21 nt, synthetic construct
  source 1..21: mol_type = other RNA
acatgccagtcacctcacttt

SEQ ID NO: 2110 - RNA, 21 nt, synthetic construct
  source 1..21: mol_type = other RNA
cggtgtctctgtgtctgcgtt

SEQ ID NO: 2111 - RNA, 21 nt, synthetic construct
  source 1..21: mol_type = other RNA
ccggtgtctctgtgtctgctt

SEQ ID NO: 2112 - RNA, 21 nt, synthetic construct
  source 1..21: mol_type = other RNA
cccggtgtctctgtgtctgtt

SEQ ID NO: 2113 - RNA, 21 nt, synthetic construct
  source 1..21: mol_type = other RNA
ccccggtgtctctgtgtcttt

SEQ ID NO: 2114 - RNA, 21 nt, synthetic construct
  source 1..21: mol_type = other RNA
gccccggtgtctctgtgtctt

SEQ ID NO: 2115 - RNA, 21 nt, synthetic construct
  source 1..21: mol_type = other RNA
ggccccggtgtctctgtgttt

SEQ ID NO: 2116 - RNA, 21 nt, synthetic construct
  source 1..21: mol_type = other RNA
gggccccggtgtctctgtgtt

SEQ ID NO: 2117 - RNA, 21 nt, synthetic construct
  source 1..21: mol_type = other RNA
tgggccccggtgtctctgttt

SEQ ID NO: 2118 - RNA, 21 nt, synthetic construct
  source 1..21: mol_type = other RNA
ctgggccccggtgtctctgtt

SEQ ID NO: 2119 - RNA, 21 nt, synthetic construct
  source 1..21: mol_type = other RNA
cctgggccccggtgtctcttt

SEQ ID NO: 2120 - RNA, 21 nt, synthetic construct
  source 1..21: mol_type = other RNA
cacatgccagtcacctcactt

SEQ ID NO: 2121 - RNA, 21 nt, synthetic construct
  source 1..21: mol_type = other RNA
ccctgggccccggtgtctctt

SEQ ID NO: 2122 - RNA, 21 nt, synthetic construct
  source 1..21: mol_type = other RNA
gccctgggccccggtgtcttt

SEQ ID NO: 2123 - RNA, 21 nt, synthetic construct
  source 1..21: mol_type = other RNA
ggccctgggccccggtgtctt

SEQ ID NO: 2124 - RNA, 21 nt, synthetic construct
  source 1..21: mol_type = other RNA
gggccctgggccccggtgttt

SEQ ID NO: 2125 - RNA, 21 nt, synthetic construct
  source 1..21: mol_type = other RNA
agggccctgggccccggtgtt

SEQ ID NO: 2126 - RNA, 21 nt, synthetic construct
  source 1..21: mol_type = other RNA
gagggccctgggccccggttt

SEQ ID NO: 2127 - RNA, 21 nt, synthetic construct
  source 1..21: mol_type = other RNA
tcttccgtgcaccgtttggtt

SEQ ID NO: 2128 - RNA, 21 nt, synthetic construct
  source 1..21: mol_type = other RNA
ggagggccctgggccccggtt

SEQ ID NO: 2129 - RNA, 21 nt, synthetic construct
  source 1..21: mol_type = other RNA
aggagggccctgggccccgtt

SEQ ID NO: 2130 - RNA, 21 nt, synthetic construct
  source 1..21: mol_type = other RNA
taggagggccctgggcccctt

SEQ ID NO: 2131 - RNA, 21 nt, synthetic construct
  source 1..21: mol_type = other RNA
ataggagggccctgggccctt

SEQ ID NO: 2132 - RNA, 21 nt, synthetic construct
  source 1..21: mol_type = other RNA
acacatgccagtcacctcatt

SEQ ID NO: 2133 - RNA, 21 nt, synthetic construct
  source 1..21: mol_type = other RNA
cataggagggccctgggcctt

SEQ ID NO: 2134 - RNA, 21 nt, synthetic construct
  source 1..21: mol_type = other RNA
ccataggagggccctgggctt

SEQ ID NO: 2135 - RNA, 21 nt, synthetic construct
  source 1..21: mol_type = other RNA
tccataggagggccctgggtt

SEQ ID NO: 2136 - RNA, 21 nt, synthetic construct
  source 1..21: mol_type = other RNA
gtccataggagggccctggtt

SEQ ID NO: 2137 - RNA, 21 nt, synthetic construct
  source 1..21: mol_type = other RNA
ggtccataggagggccctgtt

SEQ ID NO: 2138 - RNA, 21 nt, synthetic construct
  source 1..21: mol_type = other RNA
gggtccataggagggcccttt

SEQ ID NO: 2139 - RNA, 21 nt, synthetic construct
  source 1..21: mol_type = other RNA
agggtccataggagggccctt

SEQ ID NO: 2140 - RNA, 21 nt, synthetic construct
  source 1..21: mol_type = other RNA
cagggtccataggagggcctt

SEQ ID NO: 2141 - RNA, 21 nt, synthetic construct
  source 1..21: mol_type = other RNA
gcagggtccataggagggctt

SEQ ID NO: 2142 - RNA, 21 nt, synthetic construct
  source 1..21: mol_type = other RNA
ggcagggtccataggagggtt

SEQ ID NO: 2143 - RNA, 21 nt, synthetic construct
  source 1..21: mol_type = other RNA
cacacatgccagtcacctctt

SEQ ID NO: 2144 - RNA, 21 nt, synthetic construct
  source 1..21: mol_type = other RNA
gggcagggtccataggaggtt

SEQ ID NO: 2145 - RNA, 21 nt, synthetic construct
  source 1..21: mol_type = other RNA
cgggcagggtccataggagtt

SEQ ID NO: 2146 - RNA, 21 nt, synthetic construct
  source 1..21: mol_type = other RNA
gcgggcagggtccataggatt

SEQ ID NO: 2147 - RNA, 21 nt, synthetic construct
  source 1..21: mol_type = other RNA
agcgggcagggtccataggtt

SEQ ID NO: 2148 - RNA, 21 nt, synthetic construct
  source 1..21: mol_type = other RNA
gagcgggcagggtccatagtt

SEQ ID NO: 2149 - RNA, 21 nt, synthetic construct
  source 1..21: mol_type = other RNA
ggagcgggcagggtccatatt

SEQ ID NO: 2150 - RNA, 21 nt, synthetic construct
  source 1..21: mol_type = other RNA
gggagcgggcagggtccattt

SEQ ID NO: 2151 - RNA, 21 nt, synthetic construct
  source 1..21: mol_type = other RNA
ggggagcgggcagggtccatt

SEQ ID NO: 2152 - RNA, 21 nt, synthetic construct
  source 1..21: mol_type = other RNA
aggggagcgggcagggtcctt

SEQ ID NO: 2153 - RNA, 21 nt, synthetic construct
  source 1..21: mol_type = other RNA
gaggggagcgggcagggtctt

SEQ ID NO: 2154 - RNA, 21 nt, synthetic construct
  source 1..21: mol_type = other RNA
ccacacatgccagtcaccttt

SEQ ID NO: 2155 - RNA, 21 nt, synthetic construct
  source 1..21: mol_type = other RNA
ggaggggagcgggcagggttt

SEQ ID NO: 2156 - RNA, 21 nt, synthetic construct
  source 1..21: mol_type = other RNA
gggaggggagcgggcagggtt

SEQ ID NO: 2157 - RNA, 21 nt, synthetic construct
  source 1..21: mol_type = other RNA
tgggaggggagcgggcaggtt

SEQ ID NO: 2158 - RNA, 21 nt, synthetic construct
  source 1..21: mol_type = other RNA
atgggaggggagcgggcagtt

SEQ ID NO: 2159 - RNA, 21 nt, synthetic construct
  source 1..21: mol_type = other RNA
aatgggaggggagcgggcatt

SEQ ID NO: 2160 - RNA, 21 nt, synthetic construct
  source 1..21: mol_type = other RNA
caatgggaggggagcgggctt

SEQ ID NO: 2161 - RNA, 21 nt, synthetic construct
  source 1..21: mol_type = other RNA
acaatgggaggggagcgggtt

SEQ ID NO: 2162 - RNA, 21 nt, synthetic construct
  source 1..21: mol_type = other RNA
gacaatgggaggggagcggtt

SEQ ID NO: 2163 - RNA, 21 nt, synthetic construct
  source 1..21: mol_type = other RNA
ggacaatgggaggggagcgtt

SEQ ID NO: 2164 - RNA, 21 nt, synthetic construct
  source 1..21: mol_type = other RNA
tggacaatgggaggggagctt

SEQ ID NO: 2165 - RNA, 21 nt, synthetic construct
  source 1..21: mol_type = other RNA
gtggacaatgggaggggagtt

SEQ ID NO: 2166 - RNA, 21 nt, synthetic construct
  source 1..21: mol_type = other RNA
cccacacatgccagtcacctt

SEQ ID NO: 2167 - RNA, 21 nt, synthetic construct
  source 1..21: mol_type = other RNA
cgtggacaatgggaggggatt

SEQ ID NO: 2168 - RNA, 21 nt, synthetic construct
  source 1..21: mol_type = other RNA
ccgtggacaatgggaggggtt

SEQ ID NO: 2169 - RNA, 21 nt, synthetic construct
  source 1..21: mol_type = other RNA
gccgtggacaatgggagggtt

SEQ ID NO: 2170 - RNA, 21 nt, synthetic construct
  source 1..21: mol_type = other RNA
agccgtggacaatgggaggtt

SEQ ID NO: 2171 - RNA, 21 nt, synthetic construct
  source 1..21: mol_type = other RNA
cagccgtggacaatgggagtt

SEQ ID NO: 2172 - RNA, 21 nt, synthetic construct
  source 1..21: mol_type = other RNA
acagccgtggacaatgggatt

SEQ ID NO: 2173 - RNA, 21 nt, synthetic construct
  source 1..21: mol_type = other RNA
gacagccgtggacaatgggtt

SEQ ID NO: 2174 - RNA, 21 nt, synthetic construct
  source 1..21: mol_type = other RNA
ggacagccgtggacaatggtt

SEQ ID NO: 2175 - RNA, 21 nt, synthetic construct
  source 1..21: mol_type = other RNA
cggacagccgtggacaatgtt

SEQ ID NO: 2176 - RNA, 21 nt, synthetic construct
  source 1..21: mol_type = other RNA
gcggacagccgtggacaattt

SEQ ID NO: 2177 - RNA, 21 nt, synthetic construct
  source 1..21: mol_type = other RNA
ccccacacatgccagtcactt

SEQ ID NO: 2178 - RNA, 21 nt, synthetic construct
  source 1..21: mol_type = other RNA
ggcggacagccgtggacaatt

SEQ ID NO: 2179 - RNA, 21 nt, synthetic construct
  source 1..21: mol_type = other RNA
gggcggacagccgtggacatt

SEQ ID NO: 2180 - RNA, 21 nt, synthetic construct
  source 1..21: mol_type = other RNA
tgggcggacagccgtggactt

SEQ ID NO: 2181 - RNA, 21 nt, synthetic construct
  source 1..21: mol_type = other RNA
gtgggcggacagccgtggatt

SEQ ID NO: 2182 - RNA, 21 nt, synthetic construct
  source 1..21: mol_type = other RNA
ggtgggcggacagccgtggtt

SEQ ID NO: 2183 - RNA, 21 nt, synthetic construct
  source 1..21: mol_type = other RNA
gggtgggcggacagccgtgtt

SEQ ID NO: 2184 - RNA, 21 nt, synthetic construct
  source 1..21: mol_type = other RNA
ggggtgggcggacagccgttt

SEQ ID NO: 2185 - RNA, 21 nt, synthetic construct
  source 1..21: mol_type = other RNA
gggggtgggcggacagccgtt

SEQ ID NO: 2186 - RNA, 21 nt, synthetic construct
  source 1..21: mol_type = other RNA
tgggggtgggcggacagcctt

SEQ ID NO: 2187 - RNA, 21 nt, synthetic construct
  source 1..21: mol_type = other RNA
atgggggtgggcggacagctt

SEQ ID NO: 2188 - RNA, 21 nt, synthetic construct
  source 1..21: mol_type = other RNA
cccccacacatgccagtcatt

SEQ ID NO: 2189 - RNA, 21 nt, synthetic construct
  source 1..21: mol_type = other RNA
aatgggggtgggcggacagtt

SEQ ID NO: 2190 - RNA, 21 nt, synthetic construct
  source 1..21: mol_type = other RNA
gaatgggggtgggcggacatt

SEQ ID NO: 2191 - RNA, 21 nt, synthetic construct
  source 1..21: mol_type = other RNA
agaatgggggtgggcggactt

SEQ ID NO: 2192 - RNA, 21 nt, synthetic construct
  source 1..21: mol_type = other RNA
gagaatgggggtgggcggatt

SEQ ID NO: 2193 - RNA, 21 nt, synthetic construct
  source 1..21: mol_type = other RNA
ggagaatgggggtgggcggtt

SEQ ID NO: 2194 - RNA, 21 nt, synthetic construct
  source 1..21: mol_type = other RNA
tggagaatgggggtgggcgtt

SEQ ID NO: 2195 - RNA, 21 nt, synthetic construct
  source 1..21: mol_type = other RNA
ttggagaatgggggtgggctt

SEQ ID NO: 2196 - RNA, 21 nt, synthetic construct
  source 1..21: mol_type = other RNA
cttggagaatgggggtgggtt

SEQ ID NO: 2197 - RNA, 21 nt, synthetic construct
  source 1..21: mol_type = other RNA
gcttggagaatgggggtggtt

SEQ ID NO: 2198 - RNA, 21 nt, synthetic construct
  source 1..21: mol_type = other RNA
agcttggagaatgggggtgtt

SEQ ID NO: 2199 - RNA, 21 nt, synthetic construct
  source 1..21: mol_type = other RNA
gcccccacacatgccagtctt

SEQ ID NO: 2200 - RNA, 21 nt, synthetic construct
  source 1..21: mol_type = other RNA
aagcttggagaatgggggttt

SEQ ID NO: 2201 - RNA, 21 nt, synthetic construct
  source 1..21: mol_type = other RNA
gaagcttggagaatgggggtt

SEQ ID NO: 2202 - RNA, 21 nt, synthetic construct
  source 1..21: mol_type = other RNA
tgaagcttggagaatggggtt

SEQ ID NO: 2203 - RNA, 21 nt, synthetic construct
  source 1..21: mol_type = other RNA
ctgaagcttggagaatgggtt

SEQ ID NO: 2204 - RNA, 21 nt, synthetic construct
  source 1..21: mol_type = other RNA
gctgaagcttggagaatggtt

SEQ ID NO: 2205 - RNA, 21 nt, synthetic construct
  source 1..21: mol_type = other RNA
ggctgaagcttggagaatgtt

SEQ ID NO: 2206 - RNA, 21 nt, synthetic construct
  source 1..21: mol_type = other RNA
gggctgaagcttggagaattt

SEQ ID NO: 2207 - RNA, 21 nt, synthetic construct
  source 1..21: mol_type = other RNA
ggggctgaagcttggagaatt

SEQ ID NO: 2208 - RNA, 21 nt, synthetic construct
  source 1..21: mol_type = other RNA
gggggctgaagcttggagatt

SEQ ID NO: 2209 - RNA, 21 nt, synthetic construct
  source 1..21: mol_type = other RNA
agggggctgaagcttggagtt

SEQ ID NO: 2210 - RNA, 21 nt, synthetic construct
  source 1..21: mol_type = other RNA
tgcccccacacatgccagttt

SEQ ID NO: 2211 - RNA, 21 nt, synthetic construct
  source 1..21: mol_type = other RNA
gagggggctgaagcttggatt

SEQ ID NO: 2212 - RNA, 21 nt, synthetic construct
  source 1..21: mol_type = other RNA
ggagggggctgaagcttggtt

SEQ ID NO: 2213 - RNA, 21 nt, synthetic construct
  source 1..21: mol_type = other RNA
aggagggggctgaagcttgtt

SEQ ID NO: 2214 - RNA, 21 nt, synthetic construct
  source 1..21: mol_type = other RNA
aaggagggggctgaagctttt

SEQ ID NO: 2215 - RNA, 21 nt, synthetic construct
  source 1..21: mol_type = other RNA
taaggagggggctgaagcttt

SEQ ID NO: 2216 - RNA, 21 nt, synthetic construct
  source 1..21: mol_type = other RNA
ctaaggagggggctgaagctt

SEQ ID NO: 2217 - RNA, 21 nt, synthetic construct
  source 1..21: mol_type = other RNA
actaaggagggggctgaagtt

SEQ ID NO: 2218 - RNA, 21 nt, synthetic construct
  source 1..21: mol_type = other RNA
aactaaggagggggctgaatt

SEQ ID NO: 2219 - RNA, 21 nt, synthetic construct
  source 1..21: mol_type = other RNA
gaactaaggagggggctgatt

SEQ ID NO: 2220 - RNA, 21 nt, synthetic construct
  source 1..21: mol_type = other RNA
cgaactaaggagggggctgtt

SEQ ID NO: 2221 - RNA, 21 nt, synthetic construct
  source 1..21: mol_type = other RNA
ttgcccccacacatgccagtt

SEQ ID NO: 2222 - RNA, 21 nt, synthetic construct
  source 1..21: mol_type = other RNA
ccgaactaaggagggggcttt

SEQ ID NO: 2223 - RNA, 21 nt, synthetic construct
  source 1..21: mol_type = other RNA
gccgaactaaggagggggctt

SEQ ID NO: 2224 - RNA, 21 nt, synthetic construct
  source 1..21: mol_type = other RNA
tgccgaactaaggagggggtt

SEQ ID NO: 2225 - RNA, 21 nt, synthetic construct
  source 1..21: mol_type = other RNA
atgccgaactaaggaggggtt

SEQ ID NO: 2226 - RNA, 21 nt, synthetic construct
  source 1..21: mol_type = other RNA
gatgccgaactaaggagggtt

SEQ ID NO: 2227 - RNA, 21 nt, synthetic construct
  source 1..21: mol_type = other RNA
agatgccgaactaaggaggtt

SEQ ID NO: 2228 - RNA, 21 nt, synthetic construct
  source 1..21: mol_type = other RNA
cagatgccgaactaaggagtt

SEQ ID NO: 2229 - RNA, 21 nt, synthetic construct
  source 1..21: mol_type = other RNA
gcagatgccgaactaaggatt

SEQ ID NO: 2230 - RNA, 21 nt, synthetic construct
  source 1..21: mol_type = other RNA
tgcagatgccgaactaaggtt

SEQ ID NO: 2231 - RNA, 21 nt, synthetic construct
  source 1..21: mol_type = other RNA
gtgcagatgccgaactaagtt

SEQ ID NO: 2232 - RNA, 21 nt, synthetic construct
  source 1..21: mol_type = other RNA
gttgcccccacacatgccatt

SEQ ID NO: 2233 - RNA, 21 nt, synthetic construct
  source 1..21: mol_type = other RNA
tgtgcagatgccgaactaatt

SEQ ID NO: 2234 - RNA, 21 nt, synthetic construct
  source 1..21: mol_type = other RNA
ctgtgcagatgccgaactatt

SEQ ID NO: 2235 - RNA, 21 nt, synthetic construct
  source 1..21: mol_type = other RNA
gctgtgcagatgccgaacttt

SEQ ID NO: 2236 - RNA, 21 nt, synthetic construct
  source 1..21: mol_type = other RNA
tgctgtgcagatgccgaactt

SEQ ID NO: 2237 - RNA, 21 nt, synthetic construct
  source 1..21: mol_type = other RNA
gtgctgtgcagatgccgaatt

SEQ ID NO: 2238 - RNA, 21 nt, synthetic construct
  source 1..21: mol_type = other RNA
agtgctgtgcagatgccgatt

SEQ ID NO: 2239 - RNA, 21 nt, synthetic construct
  source 1..21: mol_type = other RNA
ctcttccgtgcaccgtttgtt

SEQ ID NO: 2240 - RNA, 21 nt, synthetic construct
  source 1..21: mol_type = other RNA
cagtgctgtgcagatgccgtt

SEQ ID NO: 2241 - RNA, 21 nt, synthetic construct
  source 1..21: mol_type = other RNA
tcagtgctgtgcagatgcctt

SEQ ID NO: 2242 - RNA, 21 nt, synthetic construct
  source 1..21: mol_type = other RNA
ttcagtgctgtgcagatgctt

SEQ ID NO: 2243 - RNA, 21 nt, synthetic construct
  source 1..21: mol_type = other RNA
cttcagtgctgtgcagatgtt

SEQ ID NO: 2244 - RNA, 21 nt, synthetic construct
  source 1..21: mol_type = other RNA
tgttgcccccacacatgcctt

SEQ ID NO: 2245 - RNA, 21 nt, synthetic construct
  source 1..21: mol_type = other RNA
tcttcagtgctgtgcagattt

SEQ ID NO: 2246 - RNA, 21 nt, synthetic construct
  source 1..21: mol_type = other RNA
ttcttcagtgctgtgcagatt

SEQ ID NO: 2247 - RNA, 21 nt, synthetic construct
  source 1..21: mol_type = other RNA
gttcttcagtgctgtgcagtt

SEQ ID NO: 2248 - RNA, 21 nt, synthetic construct
  source 1..21: mol_type = other RNA
ggttcttcagtgctgtgcatt

SEQ ID NO: 2249 - RNA, 21 nt, synthetic construct
  source 1..21: mol_type = other RNA
aggttcttcagtgctgtgctt

SEQ ID NO: 2250 - RNA, 21 nt, synthetic construct
  source 1..21: mol_type = other RNA
caggttcttcagtgctgtgtt

SEQ ID NO: 2251 - RNA, 21 nt, synthetic construct
  source 1..21: mol_type = other RNA
ccaggttcttcagtgctgttt

SEQ ID NO: 2252 - RNA, 21 nt, synthetic construct
  source 1..21: mol_type = other RNA
cccaggttcttcagtgctgtt

SEQ ID NO: 2253 - RNA, 21 nt, synthetic construct
  source 1..21: mol_type = other RNA
tcccaggttcttcagtgcttt

SEQ ID NO: 2254 - RNA, 21 nt, synthetic construct
  source 1..21: mol_type = other RNA
ttcccaggttcttcagtgctt

SEQ ID NO: 2255 - RNA, 21 nt, synthetic construct
  source 1..21: mol_type = other RNA
gtgttgcccccacacatgctt

SEQ ID NO: 2256 - RNA, 21 nt, synthetic construct
  source 1..21: mol_type = other RNA
attcccaggttcttcagtgtt

SEQ ID NO: 2257 - RNA, 21 nt, synthetic construct
  source 1..21: mol_type = other RNA
gattcccaggttcttcagttt

SEQ ID NO: 2258 - RNA, 21 nt, synthetic construct
  source 1..21: mol_type = other RNA
tgattcccaggttcttcagtt

SEQ ID NO: 2259 - RNA, 21 nt, synthetic construct
  source 1..21: mol_type = other RNA
ctgattcccaggttcttcatt

SEQ ID NO: 2260 - RNA, 21 nt, synthetic construct
  source 1..21: mol_type = other RNA
tctgattcccaggttcttctt

SEQ ID NO: 2261 - RNA, 21 nt, synthetic construct
  source 1..21: mol_type = other RNA
gtctgattcccaggttctttt

SEQ ID NO: 2262 - RNA, 21 nt, synthetic construct
  source 1..21: mol_type = other RNA
ggtctgattcccaggttcttt

SEQ ID NO: 2263 - RNA, 21 nt, synthetic construct
  source 1..21: mol_type = other RNA
gggtctgattcccaggttctt

SEQ ID NO: 2264 - RNA, 21 nt, synthetic construct
  source 1..21: mol_type = other RNA
agggtctgattcccaggtttt

SEQ ID NO: 2265 - RNA, 21 nt, synthetic construct
  source 1..21: mol_type = other RNA
cagggtctgattcccaggttt

SEQ ID NO: 2266 - RNA, 21 nt, synthetic construct
  source 1..21: mol_type = other RNA
cgtgttgcccccacacatgtt

SEQ ID NO: 2267 - RNA, 21 nt, synthetic construct
  source 1..21: mol_type = other RNA
tcagggtctgattcccaggtt

SEQ ID NO: 2268 - RNA, 21 nt, synthetic construct
  source 1..21: mol_type = other RNA
ctcagggtctgattcccagtt

SEQ ID NO: 2269 - RNA, 21 nt, synthetic construct
  source 1..21: mol_type = other RNA
tctcagggtctgattcccatt

SEQ ID NO: 2270 - RNA, 21 nt, synthetic construct
  source 1..21: mol_type = other RNA
gtctcagggtctgattccctt

SEQ ID NO: 2271 - RNA, 21 nt, synthetic construct
  source 1..21: mol_type = other RNA
ggtctcagggtctgattcctt

SEQ ID NO: 2272 - RNA, 21 nt, synthetic construct
  source 1..21: mol_type = other RNA
gggtctcagggtctgattctt

SEQ ID NO: 2273 - RNA, 21 nt, synthetic construct
  source 1..21: mol_type = other RNA
agggtctcagggtctgatttt

SEQ ID NO: 2274 - RNA, 21 nt, synthetic construct
  source 1..21: mol_type = other RNA
cagggtctcagggtctgattt

SEQ ID NO: 2275 - RNA, 21 nt, synthetic construct
  source 1..21: mol_type = other RNA
tcagggtctcagggtctgatt

SEQ ID NO: 2276 - RNA, 21 nt, synthetic construct
  source 1..21: mol_type = other RNA
ctcagggtctcagggtctgtt

SEQ ID NO: 2277 - RNA, 21 nt, synthetic construct
  source 1..21: mol_type = other RNA
tcgtgttgcccccacacattt

SEQ ID NO: 2278 - RNA, 21 nt, synthetic construct
  source 1..21: mol_type = other RNA
gctcagggtctcagggtcttt

SEQ ID NO: 2279 - RNA, 21 nt, synthetic construct
  source 1..21: mol_type = other RNA
tgctcagggtctcagggtctt

SEQ ID NO: 2280 - RNA, 21 nt, synthetic construct
  source 1..21: mol_type = other RNA
ttgctcagggtctcagggttt

SEQ ID NO: 2281 - RNA, 21 nt, synthetic construct
  source 1..21: mol_type = other RNA
attgctcagggtctcagggtt

SEQ ID NO: 2282 - RNA, 21 nt, synthetic construct
  source 1..21: mol_type = other RNA
gattgctcagggtctcaggtt

SEQ ID NO: 2283 - RNA, 21 nt, synthetic construct
  source 1..21: mol_type = other RNA
ggattgctcagggtctcagtt

SEQ ID NO: 2284 - RNA, 21 nt, synthetic construct
  source 1..21: mol_type = other RNA
gggattgctcagggtctcatt

SEQ ID NO: 2285 - RNA, 21 nt, synthetic construct
  source 1..21: mol_type = other RNA
tgggattgctcagggtctctt

SEQ ID NO: 2286 - RNA, 21 nt, synthetic construct
  source 1..21: mol_type = other RNA
ctgggattgctcagggtcttt

SEQ ID NO: 2287 - RNA, 21 nt, synthetic construct
  source 1..21: mol_type = other RNA
cctgggattgctcagggtctt

SEQ ID NO: 2288 - RNA, 21 nt, synthetic construct
  source 1..21: mol_type = other RNA
acctgggattgctcagggttt

SEQ ID NO: 2289 - RNA, 21 nt, synthetic construct
  source 1..21: mol_type = other RNA
atcgtgttgcccccacacatt

SEQ ID NO: 2290 - RNA, 21 nt, synthetic construct
  source 1..21: mol_type = other RNA
gacctgggattgctcagggtt

SEQ ID NO: 2291 - RNA, 21 nt, synthetic construct
  source 1..21: mol_type = other RNA
ggacctgggattgctcaggtt

SEQ ID NO: 2292 - RNA, 21 nt, synthetic construct
  source 1..21: mol_type = other RNA
tggacctgggattgctcagtt

SEQ ID NO: 2293 - RNA, 21 nt, synthetic construct
  source 1..21: mol_type = other RNA
ctggacctgggattgctcatt

SEQ ID NO: 2294 - RNA, 21 nt, synthetic construct
  source 1..21: mol_type = other RNA
gctggacctgggattgctctt

SEQ ID NO: 2295 - RNA, 21 nt, synthetic construct
  source 1..21: mol_type = other RNA
cgctggacctgggattgcttt

SEQ ID NO: 2296 - RNA, 21 nt, synthetic construct
  source 1..21: mol_type = other RNA
gcgctggacctgggattgctt

SEQ ID NO: 2297 - RNA, 21 nt, synthetic construct
  source 1..21: mol_type = other RNA
ggcgctggacctgggattgtt

SEQ ID NO: 2298 - RNA, 21 nt, synthetic construct
  source 1..21: mol_type = other RNA
tggcgctggacctgggatttt

SEQ ID NO: 2299 - RNA, 21 nt, synthetic construct
  source 1..21: mol_type = other RNA
ctggcgctggacctgggattt

SEQ ID NO: 2300 - RNA, 21 nt, synthetic construct
  source 1..21: mol_type = other RNA
aatcgtgttgcccccacactt

SEQ ID NO: 2301 - RNA, 21 nt, synthetic construct
  source 1..21: mol_type = other RNA
gctggcgctggacctgggatt

SEQ ID NO: 2302 - RNA, 21 nt, synthetic construct
  source 1..21: mol_type = other RNA
ggctggcgctggacctgggtt

SEQ ID NO: 2303 - RNA, 21 nt, synthetic construct
  source 1..21: mol_type = other RNA
gggctggcgctggacctggtt

SEQ ID NO: 2304 - RNA, 21 nt, synthetic construct
  source 1..21: mol_type = other RNA
agggctggcgctggacctgtt

SEQ ID NO: 2305 - RNA, 21 nt, synthetic construct
  source 1..21: mol_type = other RNA
tagggctggcgctggaccttt

SEQ ID NO: 2306 - RNA, 21 nt, synthetic construct
  source 1..21: mol_type = other RNA
atagggctggcgctggacctt

SEQ ID NO: 2307 - RNA, 21 nt, synthetic construct
  source 1..21: mol_type = other RNA
gatagggctggcgctggactt

SEQ ID NO: 2308 - RNA, 21 nt, synthetic construct
  source 1..21: mol_type = other RNA
tgatagggctggcgctggatt

SEQ ID NO: 2309 - RNA, 21 nt, synthetic construct
  source 1..21: mol_type = other RNA
atgatagggctggcgctggtt

SEQ ID NO: 2310 - RNA, 21 nt, synthetic construct
  source 1..21: mol_type = other RNA
catgatagggctggcgctgtt

SEQ ID NO: 2311 - RNA, 21 nt, synthetic construct
  source 1..21: mol_type = other RNA
gaatcgtgttgcccccacatt

SEQ ID NO: 2312 - RNA, 21 nt, synthetic construct
  source 1..21: mol_type = other RNA
tcatgatagggctggcgcttt

SEQ ID NO: 2313 - RNA, 21 nt, synthetic construct
  source 1..21: mol_type = other RNA
gtcatgatagggctggcgctt

SEQ ID NO: 2314 - RNA, 21 nt, synthetic construct
  source 1..21: mol_type = other RNA
ggtcatgatagggctggcgtt

SEQ ID NO: 2315 - RNA, 21 nt, synthetic construct
  source 1..21: mol_type = other RNA
tggtcatgatagggctggctt

SEQ ID NO: 2316 - RNA, 21 nt, synthetic construct
  source 1..21: mol_type = other RNA
ttggtcatgatagggctggtt

SEQ ID NO: 2317 - RNA, 21 nt, synthetic construct
  source 1..21: mol_type = other RNA
cttggtcatgatagggctgtt

SEQ ID NO: 2318 - RNA, 21 nt, synthetic construct
  source 1..21: mol_type = other RNA
ccttggtcatgatagggcttt

SEQ ID NO: 2319 - RNA, 21 nt, synthetic construct
  source 1..21: mol_type = other RNA
tccttggtcatgatagggctt

SEQ ID NO: 2320 - RNA, 21 nt, synthetic construct
  source 1..21: mol_type = other RNA
ctccttggtcatgatagggtt

SEQ ID NO: 2321 - RNA, 21 nt, synthetic construct
  source 1..21: mol_type = other RNA
actccttggtcatgataggtt

SEQ ID NO: 2322 - RNA, 21 nt, synthetic construct
  source 1..21: mol_type = other RNA
agaatcgtgttgcccccactt

SEQ ID NO: 2323 - RNA, 21 nt, synthetic construct
  source 1..21: mol_type = other RNA
tactccttggtcatgatagtt

SEQ ID NO: 2324 - RNA, 21 nt, synthetic construct
  source 1..21: mol_type = other RNA
atactccttggtcatgatatt

SEQ ID NO: 2325 - RNA, 21 nt, synthetic construct
  source 1..21: mol_type = other RNA
gatactccttggtcatgattt

SEQ ID NO: 2326 - RNA, 21 nt, synthetic construct
  source 1..21: mol_type = other RNA
tgatactccttggtcatgatt

SEQ ID NO: 2327 - RNA, 21 nt, synthetic construct
  source 1..21: mol_type = other RNA
ttgatactccttggtcatgtt

SEQ ID NO: 2328 - RNA, 21 nt, synthetic construct
  source 1..21: mol_type = other RNA
cttgatactccttggtcattt

SEQ ID NO: 2329 - RNA, 21 nt, synthetic construct
  source 1..21: mol_type = other RNA
tcttgatactccttggtcatt

SEQ ID NO: 2330 - RNA, 21 nt, synthetic construct
  source 1..21: mol_type = other RNA
gtcttgatactccttggtctt

SEQ ID NO: 2331 - RNA, 21 nt, synthetic construct
  source 1..21: mol_type = other RNA
ggtcttgatactccttggttt

SEQ ID NO: 2332 - RNA, 21 nt, synthetic construct
  source 1..21: mol_type = other RNA
aggtcttgatactccttggtt

SEQ ID NO: 2333 - RNA, 21 nt, synthetic construct
  source 1..21: mol_type = other RNA
gagaatcgtgttgcccccatt

SEQ ID NO: 2334 - RNA, 21 nt, synthetic construct
  source 1..21: mol_type = other RNA
aaggtcttgatactccttgtt

SEQ ID NO: 2335 - RNA, 21 nt, synthetic construct
  source 1..21: mol_type = other RNA
gaaggtcttgatactcctttt

SEQ ID NO: 2336 - RNA, 21 nt, synthetic construct
  source 1..21: mol_type = other RNA
tgaaggtcttgatactccttt

SEQ ID NO: 2337 - RNA, 21 nt, synthetic construct
  source 1..21: mol_type = other RNA
ctgaaggtcttgatactcctt

SEQ ID NO: 2338 - RNA, 21 nt, synthetic construct
  source 1..21: mol_type = other RNA
gctgaaggtcttgatactctt

SEQ ID NO: 2339 - RNA, 21 nt, synthetic construct
  source 1..21: mol_type = other RNA
tgctgaaggtcttgatacttt

SEQ ID NO: 2340 - RNA, 21 nt, synthetic construct
  source 1..21: mol_type = other RNA
atgctgaaggtcttgatactt

SEQ ID NO: 2341 - RNA, 21 nt, synthetic construct
  source 1..21: mol_type = other RNA
gatgctgaaggtcttgatatt

SEQ ID NO: 2342 - RNA, 21 nt, synthetic construct
  source 1..21: mol_type = other RNA
agatgctgaaggtcttgattt

SEQ ID NO: 2343 - RNA, 21 nt, synthetic construct
  source 1..21: mol_type = other RNA
cagatgctgaaggtcttgatt

SEQ ID NO: 2344 - RNA, 21 nt, synthetic construct
  source 1..21: mol_type = other RNA
ggagaatcgtgttgccccctt

SEQ ID NO: 2345 - RNA, 21 nt, synthetic construct
  source 1..21: mol_type = other RNA
ccagatgctgaaggtcttgtt

SEQ ID NO: 2346 - RNA, 21 nt, synthetic construct
  source 1..21: mol_type = other RNA
tccagatgctgaaggtctttt

SEQ ID NO: 2347 - RNA, 21 nt, synthetic construct
  source 1..21: mol_type = other RNA
gtccagatgctgaaggtcttt

SEQ ID NO: 2348 - RNA, 21 nt, synthetic construct
  source 1..21: mol_type = other RNA
tgtccagatgctgaaggtctt

SEQ ID NO: 2349 - RNA, 21 nt, synthetic construct
  source 1..21: mol_type = other RNA
ttgtccagatgctgaaggttt

SEQ ID NO: 2350 - RNA, 21 nt, synthetic construct
  source 1..21: mol_type = other RNA
attgtccagatgctgaaggtt

SEQ ID NO: 2351 - RNA, 21 nt, synthetic construct
  source 1..21: mol_type = other RNA
actcttccgtgcaccgttttt

SEQ ID NO: 2352 - RNA, 21 nt, synthetic construct
  source 1..21: mol_type = other RNA
cattgtccagatgctgaagtt

SEQ ID NO: 2353 - RNA, 21 nt, synthetic construct
  source 1..21: mol_type = other RNA
tcattgtccagatgctgaatt

SEQ ID NO: 2354 - RNA, 21 nt, synthetic construct
  source 1..21: mol_type = other RNA
ctcattgtccagatgctgatt

SEQ ID NO: 2355 - RNA, 21 nt, synthetic construct
  source 1..21: mol_type = other RNA
cctcattgtccagatgctgtt

SEQ ID NO: 2356 - RNA, 21 nt, synthetic construct
  source 1..21: mol_type = other RNA
aggagaatcgtgttgcccctt

SEQ ID NO: 2357 - RNA, 21 nt, synthetic construct
  source 1..21: mol_type = other RNA
tcctcattgtccagatgcttt

SEQ ID NO: 2358 - RNA, 21 nt, synthetic construct
  source 1..21: mol_type = other RNA
ctcctcattgtccagatgctt

SEQ ID NO: 2359 - RNA, 21 nt, synthetic construct
  source 1..21: mol_type = other RNA
tctcctcattgtccagatgtt

SEQ ID NO: 2360 - RNA, 21 nt, synthetic construct
  source 1..21: mol_type = other RNA
ctctcctcattgtccagattt

SEQ ID NO: 2361 - RNA, 21 nt, synthetic construct
  source 1..21: mol_type = other RNA
actctcctcattgtccagatt

SEQ ID NO: 2362 - RNA, 21 nt, synthetic construct
  source 1..21: mol_type = other RNA
cactctcctcattgtccagtt

SEQ ID NO: 2363 - RNA, 21 nt, synthetic construct
  source 1..21: mol_type = other RNA
tcactctcctcattgtccatt

SEQ ID NO: 2364 - RNA, 21 nt, synthetic construct
  source 1..21: mol_type = other RNA
gtcactctcctcattgtcctt

SEQ ID NO: 2365 - RNA, 21 nt, synthetic construct
  source 1..21: mol_type = other RNA
ggtcactctcctcattgtctt

SEQ ID NO: 2366 - RNA, 21 nt, synthetic construct
  source 1..21: mol_type = other RNA
tggtcactctcctcattgttt

SEQ ID NO: 2367 - RNA, 21 nt, synthetic construct
  source 1..21: mol_type = other RNA
gaggagaatcgtgttgccctt

SEQ ID NO: 2368 - RNA, 21 nt, synthetic construct
  source 1..21: mol_type = other RNA
gtggtcactctcctcattgtt

SEQ ID NO: 2369 - RNA, 21 nt, synthetic construct
  source 1..21: mol_type = other RNA
ggtggtcactctcctcatttt

SEQ ID NO: 2370 - RNA, 21 nt, synthetic construct
  source 1..21: mol_type = other RNA
tggtggtcactctcctcattt

SEQ ID NO: 2371 - RNA, 21 nt, synthetic construct
  source 1..21: mol_type = other RNA
atggtggtcactctcctcatt

SEQ ID NO: 2372 - RNA, 21 nt, synthetic construct
  source 1..21: mol_type = other RNA
gatggtggtcactctcctctt

SEQ ID NO: 2373 - RNA, 21 nt, synthetic construct
  source 1..21: mol_type = other RNA
tgatggtggtcactctccttt

SEQ ID NO: 2374 - RNA, 21 nt, synthetic construct
  source 1..21: mol_type = other RNA
ctgatggtggtcactctcctt

SEQ ID NO: 2375 - RNA, 21 nt, synthetic construct
  source 1..21: mol_type = other RNA
gctgatggtggtcactctctt

SEQ ID NO: 2376 - RNA, 21 nt, synthetic construct
  source 1..21: mol_type = other RNA
agctgatggtggtcactcttt

SEQ ID NO: 2377 - RNA, 21 nt, synthetic construct
  source 1..21: mol_type = other RNA
gagctgatggtggtcactctt

SEQ ID NO: 2378 - RNA, 21 nt, synthetic construct
  source 1..21: mol_type = other RNA
ggaggagaatcgtgttgcctt

SEQ ID NO: 2379 - RNA, 21 nt, synthetic construct
  source 1..21: mol_type = other RNA
tgagctgatggtggtcacttt

SEQ ID NO: 2380 - RNA, 21 nt, synthetic construct
  source 1..21: mol_type = other RNA
ctgagctgatggtggtcactt

SEQ ID NO: 2381 - RNA, 21 nt, synthetic construct
  source 1..21: mol_type = other RNA
tctgagctgatggtggtcatt

SEQ ID NO: 2382 - RNA, 21 nt, synthetic construct
  source 1..21: mol_type = other RNA
ttctgagctgatggtggtctt

SEQ ID NO: 2383 - RNA, 21 nt, synthetic construct
  source 1..21: mol_type = other RNA
tttctgagctgatggtggttt

SEQ ID NO: 2384 - RNA, 21 nt, synthetic construct
  source 1..21: mol_type = other RNA
ttttctgagctgatggtggtt

SEQ ID NO: 2385 - RNA, 21 nt, synthetic construct
  source 1..21: mol_type = other RNA
cttttctgagctgatggtgtt

SEQ ID NO: 2386 - RNA, 21 nt, synthetic construct
  source 1..21: mol_type = other RNA
ccttttctgagctgatggttt

SEQ ID NO: 2387 - RNA, 21 nt, synthetic construct
  source 1..21: mol_type = other RNA
cccttttctgagctgatggtt

SEQ ID NO: 2388 - RNA, 21 nt, synthetic construct
  source 1..21: mol_type = other RNA
gcccttttctgagctgatgtt

SEQ ID NO: 2389 - RNA, 21 nt, synthetic construct
  source 1..21: mol_type = other RNA
gggaggagaatcgtgttgctt

SEQ ID NO: 2390 - RNA, 21 nt, synthetic construct
  source 1..21: mol_type = other RNA
ggcccttttctgagctgattt

SEQ ID NO: 2391 - RNA, 21 nt, synthetic construct
  source 1..21: mol_type = other RNA
tggcccttttctgagctgatt

SEQ ID NO: 2392 - RNA, 21 nt, synthetic construct
  source 1..21: mol_type = other RNA
gtggcccttttctgagctgtt

SEQ ID NO: 2393 - RNA, 21 nt, synthetic construct
  source 1..21: mol_type = other RNA
ggtggcccttttctgagcttt

SEQ ID NO: 2394 - RNA, 21 nt, synthetic construct
  source 1..21: mol_type = other RNA
aggtggcccttttctgagctt

SEQ ID NO: 2395 - RNA, 21 nt, synthetic construct
  source 1..21: mol_type = other RNA
gaggtggcccttttctgagtt

SEQ ID NO: 2396 - RNA, 21 nt, synthetic construct
  source 1..21: mol_type = other RNA
ggaggtggcccttttctgatt

SEQ ID NO: 2397 - RNA, 21 nt, synthetic construct
  source 1..21: mol_type = other RNA
aggaggtggcccttttctgtt

SEQ ID NO: 2398 - RNA, 21 nt, synthetic construct
  source 1..21: mol_type = other RNA
gaggaggtggcccttttcttt

SEQ ID NO: 2399 - RNA, 21 nt, synthetic construct
  source 1..21: mol_type = other RNA
ggaggaggtggcccttttctt

SEQ ID NO: 2400 - RNA, 21 nt, synthetic construct
  source 1..21: mol_type = other RNA
agggaggagaatcgtgttgtt

SEQ ID NO: 2401 - RNA, 21 nt, synthetic construct
  source 1..21: mol_type = other RNA
gggaggaggtggccctttttt

SEQ ID NO: 2402 - RNA, 21 nt, synthetic construct
  source 1..21: mol_type = other RNA
ggggaggaggtggcccttttt

SEQ ID NO: 2403 - RNA, 21 nt, synthetic construct
  source 1..21: mol_type = other RNA
tggggaggaggtggccctttt

SEQ ID NO: 2404 - RNA, 21 nt, synthetic construct
  source 1..21: mol_type = other RNA
ctggggaggaggtggcccttt

SEQ ID NO: 2405 - RNA, 21 nt, synthetic construct
  source 1..21: mol_type = other RNA
gctggggaggaggtggccctt

SEQ ID NO: 2406 - RNA, 21 nt, synthetic construct
  source 1..21: mol_type = other RNA
ggctggggaggaggtggcctt

SEQ ID NO: 2407 - RNA, 21 nt, synthetic construct
  source 1..21: mol_type = other RNA
gggctggggaggaggtggctt

SEQ ID NO: 2408 - RNA, 21 nt, synthetic construct
  source 1..21: mol_type = other RNA
ggggctggggaggaggtggtt

SEQ ID NO: 2409 - RNA, 21 nt, synthetic construct
  source 1..21: mol_type = other RNA
aggggctggggaggaggtgtt

SEQ ID NO: 2410 - RNA, 21 nt, synthetic construct
  source 1..21: mol_type = other RNA
gaggggctggggaggaggttt

SEQ ID NO: 2411 - RNA, 21 nt, synthetic construct
  source 1..21: mol_type = other RNA
ggaggggctggggaggaggtt

SEQ ID NO: 2412 - RNA, 21 nt, synthetic construct
  source 1..21: mol_type = other RNA
cagggaggagaatcgtgtttt

SEQ ID NO: 2413 - RNA, 21 nt, synthetic construct
  source 1..21: mol_type = other RNA
aggaggggctggggaggagtt

SEQ ID NO: 2414 - RNA, 21 nt, synthetic construct
  source 1..21: mol_type = other RNA
caggaggggctggggaggatt

SEQ ID NO: 2415 - RNA, 21 nt, synthetic construct
  source 1..21: mol_type = other RNA
gcaggaggggctggggaggtt

SEQ ID NO: 2416 - RNA, 21 nt, synthetic construct
  source 1..21: mol_type = other RNA
tgcaggaggggctggggagtt

SEQ ID NO: 2417 - RNA, 21 nt, synthetic construct
  source 1..21: mol_type = other RNA
ctgcaggaggggctggggatt

SEQ ID NO: 2418 - RNA, 21 nt, synthetic construct
  source 1..21: mol_type = other RNA
gctgcaggaggggctggggtt

SEQ ID NO: 2419 - RNA, 21 nt, synthetic construct
  source 1..21: mol_type = other RNA
cgctgcaggaggggctgggtt

SEQ ID NO: 2420 - RNA, 21 nt, synthetic construct
  source 1..21: mol_type = other RNA
acgctgcaggaggggctggtt

SEQ ID NO: 2421 - RNA, 21 nt, synthetic construct
  source 1..21: mol_type = other RNA
gacgctgcaggaggggctgtt

SEQ ID NO: 2422 - RNA, 21 nt, synthetic construct
  source 1..21: mol_type = other RNA
agacgctgcaggaggggcttt

SEQ ID NO: 2423 - RNA, 21 nt, synthetic construct
  source 1..21: mol_type = other RNA
ccagggaggagaatcgtgttt

SEQ ID NO: 2424 - RNA, 21 nt, synthetic construct
  source 1..21: mol_type = other RNA
gagacgctgcaggaggggctt

SEQ ID NO: 2425 - RNA, 21 nt, synthetic construct
  source 1..21: mol_type = other RNA
agagacgctgcaggaggggtt

SEQ ID NO: 2426 - RNA, 21 nt, synthetic construct
  source 1..21: mol_type = other RNA
cagagacgctgcaggagggtt

SEQ ID NO: 2427 - RNA, 21 nt, synthetic construct
  source 1..21: mol_type = other RNA
gcagagacgctgcaggaggtt

SEQ ID NO: 2428 - RNA, 21 nt, synthetic construct
  source 1..21: mol_type = other RNA
agcagagacgctgcaggagtt

SEQ ID NO: 2429 - RNA, 21 nt, synthetic construct
  source 1..21: mol_type = other RNA
gagcagagacgctgcaggatt

SEQ ID NO: 2430 - RNA, 21 nt, synthetic construct
  source 1..21: mol_type = other RNA
ggagcagagacgctgcaggtt

SEQ ID NO: 2431 - RNA, 21 nt, synthetic construct
  source 1..21: mol_type = other RNA
cggagcagagacgctgcagtt

SEQ ID NO: 2432 - RNA, 21 nt, synthetic construct
  source 1..21: mol_type = other RNA
ccggagcagagacgctgcatt

SEQ ID NO: 2433 - RNA, 21 nt, synthetic construct
  source 1..21: mol_type = other RNA
tccggagcagagacgctgctt

SEQ ID NO: 2434 - RNA, 21 nt, synthetic construct
  source 1..21: mol_type = other RNA
cccagggaggagaatcgtgtt

SEQ ID NO: 2435 - RNA, 21 nt, synthetic construct
  source 1..21: mol_type = other RNA
gtccggagcagagacgctgtt

SEQ ID NO: 2436 - RNA, 21 nt, synthetic construct
  source 1..21: mol_type = other RNA
ggtccggagcagagacgcttt

SEQ ID NO: 2437 - RNA, 21 nt, synthetic construct
  source 1..21: mol_type = other RNA
aggtccggagcagagacgctt

SEQ ID NO: 2438 - RNA, 21 nt, synthetic construct
  source 1..21: mol_type = other RNA
gaggtccggagcagagacgtt

SEQ ID NO: 2439 - RNA, 21 nt, synthetic construct
  source 1..21: mol_type = other RNA
cgaggtccggagcagagactt

SEQ ID NO: 2440 - RNA, 21 nt, synthetic construct
  source 1..21: mol_type = other RNA
gcgaggtccggagcagagatt

SEQ ID NO: 2441 - RNA, 21 nt, synthetic construct
  source 1..21: mol_type = other RNA
ggcgaggtccggagcagagtt

SEQ ID NO: 2442 - RNA, 21 nt, synthetic construct
  source 1..21: mol_type = other RNA
aggcgaggtccggagcagatt

SEQ ID NO: 2443 - RNA, 21 nt, synthetic construct
  source 1..21: mol_type = other RNA
gaggcgaggtccggagcagtt

SEQ ID NO: 2444 - RNA, 21 nt, synthetic construct
  source 1..21: mol_type = other RNA
ggaggcgaggtccggagcatt

SEQ ID NO: 2445 - RNA, 21 nt, synthetic construct
  source 1..21: mol_type = other RNA
ccccagggaggagaatcgttt

SEQ ID NO: 2446 - RNA, 21 nt, synthetic construct
  source 1..21: mol_type = other RNA
aggaggcgaggtccggagctt

SEQ ID NO: 2447 - RNA, 21 nt, synthetic construct
  source 1..21: mol_type = other RNA
gaggaggcgaggtccggagtt

SEQ ID NO: 2448 - RNA, 21 nt, synthetic construct
  source 1..21: mol_type = other RNA
ggaggaggcgaggtccggatt

SEQ ID NO: 2449 - RNA, 21 nt, synthetic construct
  source 1..21: mol_type = other RNA
aggaggaggcgaggtccggtt

SEQ ID NO: 2450 - RNA, 21 nt, synthetic construct
  source 1..21: mol_type = other RNA
caggaggaggcgaggtccgtt

SEQ ID NO: 2451 - RNA, 21 nt, synthetic construct
  source 1..21: mol_type = other RNA
gcaggaggaggcgaggtcctt

SEQ ID NO: 2452 - RNA, 21 nt, synthetic construct
  source 1..21: mol_type = other RNA
agcaggaggaggcgaggtctt

SEQ ID NO: 2453 - RNA, 21 nt, synthetic construct
  source 1..21: mol_type = other RNA
gagcaggaggaggcgaggttt

SEQ ID NO: 2454 - RNA, 21 nt, synthetic construct
  source 1..21: mol_type = other RNA
agagcaggaggaggcgaggtt

SEQ ID NO: 2455 - RNA, 21 nt, synthetic construct
  source 1..21: mol_type = other RNA
gagagcaggaggaggcgagtt

SEQ ID NO: 2456 - RNA, 21 nt, synthetic construct
  source 1..21: mol_type = other RNA
tccccagggaggagaatcgtt

SEQ ID NO: 2457 - RNA, 21 nt, synthetic construct
  source 1..21: mol_type = other RNA
ggagagcaggaggaggcgatt

SEQ ID NO: 2458 - RNA, 21 nt, synthetic construct
  source 1..21: mol_type = other RNA
gggagagcaggaggaggcgtt

SEQ ID NO: 2459 - RNA, 21 nt, synthetic construct
  source 1..21: mol_type = other RNA
agggagagcaggaggaggctt

SEQ ID NO: 2460 - RNA, 21 nt, synthetic construct
  source 1..21: mol_type = other RNA
cagggagagcaggaggaggtt

SEQ ID NO: 2461 - RNA, 21 nt, synthetic construct
  source 1..21: mol_type = other RNA
ccagggagagcaggaggagtt

SEQ ID NO: 2462 - RNA, 21 nt, synthetic construct
  source 1..21: mol_type = other RNA
cccagggagagcaggaggatt

SEQ ID NO: 2463 - RNA, 21 nt, synthetic construct
  source 1..21: mol_type = other RNA
cactcttccgtgcaccgtttt

SEQ ID NO: 2464 - RNA, 21 nt, synthetic construct
  source 1..21: mol_type = other RNA
gcccagggagagcaggaggtt

SEQ ID NO: 2465 - RNA, 21 nt, synthetic construct
  source 1..21: mol_type = other RNA
ggcccagggagagcaggagtt

SEQ ID NO: 2466 - RNA, 21 nt, synthetic construct
  source 1..21: mol_type = other RNA
aggcccagggagagcaggatt

SEQ ID NO: 2467 - RNA, 21 nt, synthetic construct
  source 1..21: mol_type = other RNA
gaggcccagggagagcaggtt

SEQ ID NO: 2468 - RNA, 21 nt, synthetic construct
  source 1..21: mol_type = other RNA
ctccccagggaggagaatctt

SEQ ID NO: 2469 - RNA, 21 nt, synthetic construct
  source 1..21: mol_type = other RNA
tgaggcccagggagagcagtt

SEQ ID NO: 2470 - RNA, 21 nt, synthetic construct
  source 1..21: mol_type = other RNA
ctgaggcccagggagagcatt

SEQ ID NO: 2471 - RNA, 21 nt, synthetic construct
  source 1..21: mol_type = other RNA
gctgaggcccagggagagctt

SEQ ID NO: 2472 - RNA, 21 nt, synthetic construct
  source 1..21: mol_type = other RNA
ggctgaggcccagggagagtt

SEQ ID NO: 2473 - RNA, 21 nt, synthetic construct
  source 1..21: mol_type = other RNA
aggctgaggcccagggagatt

SEQ ID NO: 2474 - RNA, 21 nt, synthetic construct
  source 1..21: mol_type = other RNA
gaggctgaggcccagggagtt

SEQ ID NO: 2475 - RNA, 21 nt, synthetic construct
  source 1..21: mol_type = other RNA
ggaggctgaggcccagggatt

SEQ ID NO: 2476 - RNA, 21 nt, synthetic construct
  source 1..21: mol_type = other RNA
aggaggctgaggcccagggtt

SEQ ID NO: 2477 - RNA, 21 nt, synthetic construct
  source 1..21: mol_type = other RNA
caggaggctgaggcccaggtt

SEQ ID NO: 2478 - RNA, 21 nt, synthetic construct
  source 1..21: mol_type = other RNA
gcaggaggctgaggcccagtt

SEQ ID NO: 2479 - RNA, 21 nt, synthetic construct
  source 1..21: mol_type = other RNA
gctccccagggaggagaattt

SEQ ID NO: 2480 - RNA, 21 nt, synthetic construct
  source 1..21: mol_type = other RNA
agcaggaggctgaggcccatt

SEQ ID NO: 2481 - RNA, 21 nt, synthetic construct
  source 1..21: mol_type = other RNA
cagcaggaggctgaggccctt

SEQ ID NO: 2482 - RNA, 21 nt, synthetic construct
  source 1..21: mol_type = other RNA
gcagcaggaggctgaggcctt

SEQ ID NO: 2483 - RNA, 21 nt, synthetic construct
  source 1..21: mol_type = other RNA
agcagcaggaggctgaggctt

SEQ ID NO: 2484 - RNA, 21 nt, synthetic construct
  source 1..21: mol_type = other RNA
aagcagcaggaggctgaggtt

SEQ ID NO: 2485 - RNA, 21 nt, synthetic construct
  source 1..21: mol_type = other RNA
caagcagcaggaggctgagtt

SEQ ID NO: 2486 - RNA, 21 nt, synthetic construct
  source 1..21: mol_type = other RNA
acaagcagcaggaggctgatt

SEQ ID NO: 2487 - RNA, 21 nt, synthetic construct
  source 1..21: mol_type = other RNA
cacaagcagcaggaggctgtt

SEQ ID NO: 2488 - RNA, 21 nt, synthetic construct
  source 1..21: mol_type = other RNA
ccacaagcagcaggaggcttt

SEQ ID NO: 2489 - RNA, 21 nt, synthetic construct
  source 1..21: mol_type = other RNA
accacaagcagcaggaggctt

SEQ ID NO: 2490 - RNA, 21 nt, synthetic construct
  source 1..21: mol_type = other RNA
tgctccccagggaggagaatt

SEQ ID NO: 2491 - RNA, 21 nt, synthetic construct
  source 1..21: mol_type = other RNA
aaccacaagcagcaggaggtt

SEQ ID NO: 2492 - RNA, 21 nt, synthetic construct
  source 1..21: mol_type = other RNA
caaccacaagcagcaggagtt

SEQ ID NO: 2493 - RNA, 21 nt, synthetic construct
  source 1..21: mol_type = other RNA
acaaccacaagcagcaggatt

SEQ ID NO: 2494 - RNA, 21 nt, synthetic construct
  source 1..21: mol_type = other RNA
gacaaccacaagcagcaggtt

SEQ ID NO: 2495 - RNA, 21 nt, synthetic construct
  source 1..21: mol_type = other RNA
agacaaccacaagcagcagtt

SEQ ID NO: 2496 - RNA, 21 nt, synthetic construct
  source 1..21: mol_type = other RNA
cagacaaccacaagcagcatt

SEQ ID NO: 2497 - RNA, 21 nt, synthetic construct
  source 1..21: mol_type = other RNA
acagacaaccacaagcagctt

SEQ ID NO: 2498 - RNA, 21 nt, synthetic construct
  source 1..21: mol_type = other RNA
cacagacaaccacaagcagtt

SEQ ID NO: 2499 - RNA, 21 nt, synthetic construct
  source 1..21: mol_type = other RNA
acacagacaaccacaagcatt

SEQ ID NO: 2500 - RNA, 21 nt, synthetic construct
  source 1..21: mol_type = other RNA
cacacagacaaccacaagctt

SEQ ID NO: 2501 - RNA, 21 nt, synthetic construct
  source 1..21: mol_type = other RNA
ctgctccccagggaggagatt

SEQ ID NO: 2502 - RNA, 21 nt, synthetic construct
  source 1..21: mol_type = other RNA
tcacacagacaaccacaagtt

SEQ ID NO: 2503 - RNA, 21 nt, synthetic construct
  source 1..21: mol_type = other RNA
atcacacagacaaccacaatt

SEQ ID NO: 2504 - RNA, 21 nt, synthetic construct
  source 1..21: mol_type = other RNA
gatcacacagacaaccacatt

SEQ ID NO: 2505 - RNA, 21 nt, synthetic construct
  source 1..21: mol_type = other RNA
cgatcacacagacaaccactt

SEQ ID NO: 2506 - RNA, 21 nt, synthetic construct
  source 1..21: mol_type = other RNA
ccgatcacacagacaaccatt

SEQ ID NO: 2507 - RNA, 21 nt, synthetic construct
  source 1..21: mol_type = other RNA
tccgatcacacagacaacctt

SEQ ID NO: 2508 - RNA, 21 nt, synthetic construct
  source 1..21: mol_type = other RNA
atccgatcacacagacaactt

SEQ ID NO: 2509 - RNA, 21 nt, synthetic construct
  source 1..21: mol_type = other RNA
gatccgatcacacagacaatt

SEQ ID NO: 2510 - RNA, 21 nt, synthetic construct
  source 1..21: mol_type = other RNA
ggatccgatcacacagacatt

SEQ ID NO: 2511 - RNA, 21 nt, synthetic construct
  source 1..21: mol_type = other RNA
gggatccgatcacacagactt

SEQ ID NO: 2512 - RNA, 21 nt, synthetic construct
  source 1..21: mol_type = other RNA
tctgctccccagggaggagtt

SEQ ID NO: 2513 - RNA, 21 nt, synthetic construct
  source 1..21: mol_type = other RNA
tgggatccgatcacacagatt

SEQ ID NO: 2514 - RNA, 21 nt, synthetic construct
  source 1..21: mol_type = other RNA
ttgggatccgatcacacagtt

SEQ ID NO: 2515 - RNA, 21 nt, synthetic construct
  source 1..21: mol_type = other RNA
tttgggatccgatcacacatt

SEQ ID NO: 2516 - RNA, 21 nt, synthetic construct
  source 1..21: mol_type = other RNA
ttttgggatccgatcacactt

SEQ ID NO: 2517 - RNA, 21 nt, synthetic construct
  source 1..21: mol_type = other RNA
gttttgggatccgatcacatt

SEQ ID NO: 2518 - RNA, 21 nt, synthetic construct
  source 1..21: mol_type = other RNA
agttttgggatccgatcactt

SEQ ID NO: 2519 - RNA, 21 nt, synthetic construct
  source 1..21: mol_type = other RNA
gagttttgggatccgatcatt

SEQ ID NO: 2520 - RNA, 21 nt, synthetic construct
  source 1..21: mol_type = other RNA
ggagttttgggatccgatctt

SEQ ID NO: 2521 - RNA, 21 nt, synthetic construct
  source 1..21: mol_type = other RNA
gggagttttgggatccgattt

SEQ ID NO: 2522 - RNA, 21 nt, synthetic construct
  source 1..21: mol_type = other RNA
tgggagttttgggatccgatt

SEQ ID NO: 2523 - RNA, 21 nt, synthetic construct
  source 1..21: mol_type = other RNA
ctctgctccccagggaggatt

SEQ ID NO: 2524 - RNA, 21 nt, synthetic construct
  source 1..21: mol_type = other RNA
ctgggagttttgggatccgtt

SEQ ID NO: 2525 - RNA, 21 nt, synthetic construct
  source 1..21: mol_type = other RNA
gctgggagttttgggatcctt

SEQ ID NO: 2526 - RNA, 21 nt, synthetic construct
  source 1..21: mol_type = other RNA
agctgggagttttgggatctt

SEQ ID NO: 2527 - RNA, 21 nt, synthetic construct
  source 1..21: mol_type = other RNA
cagctgggagttttgggattt

SEQ ID NO: 2528 - RNA, 21 nt, synthetic construct
  source 1..21: mol_type = other RNA
gcagctgggagttttgggatt

SEQ ID NO: 2529 - RNA, 21 nt, synthetic construct
  source 1..21: mol_type = other RNA
tgcagctgggagttttgggtt

SEQ ID NO: 2530 - RNA, 21 nt, synthetic construct
  source 1..21: mol_type = other RNA
ctgcagctgggagttttggtt

SEQ ID NO: 2531 - RNA, 21 nt, synthetic construct
  source 1..21: mol_type = other RNA
cctgcagctgggagttttgtt

SEQ ID NO: 2532 - RNA, 21 nt, synthetic construct
  source 1..21: mol_type = other RNA
tcctgcagctgggagtttttt

SEQ ID NO: 2533 - RNA, 21 nt, synthetic construct
  source 1..21: mol_type = other RNA
ctcctgcagctgggagttttt

SEQ ID NO: 2534 - RNA, 21 nt, synthetic construct
  source 1..21: mol_type = other RNA
gctctgctccccagggaggtt

SEQ ID NO: 2535 - RNA, 21 nt, synthetic construct
  source 1..21: mol_type = other RNA
cctcctgcagctgggagtttt

SEQ ID NO: 2536 - RNA, 21 nt, synthetic construct
  source 1..21: mol_type = other RNA
tcctcctgcagctgggagttt

SEQ ID NO: 2537 - RNA, 21 nt, synthetic construct
  source 1..21: mol_type = other RNA
ctcctcctgcagctgggagtt

SEQ ID NO: 2538 - RNA, 21 nt, synthetic construct
  source 1..21: mol_type = other RNA
gctcctcctgcagctgggatt

SEQ ID NO: 2539 - RNA, 21 nt, synthetic construct
  source 1..21: mol_type = other RNA
agctcctcctgcagctgggtt

SEQ ID NO: 2540 - RNA, 21 nt, synthetic construct
  source 1..21: mol_type = other RNA
cagctcctcctgcagctggtt

SEQ ID NO: 2541 - RNA, 21 nt, synthetic construct
  source 1..21: mol_type = other RNA
gcagctcctcctgcagctgtt

SEQ ID NO: 2542 - RNA, 21 nt, synthetic construct
  source 1..21: mol_type = other RNA
cgcagctcctcctgcagcttt

SEQ ID NO: 2543 - RNA, 21 nt, synthetic construct
  source 1..21: mol_type = other RNA
ccgcagctcctcctgcagctt

SEQ ID NO: 2544 - RNA, 21 nt, synthetic construct
  source 1..21: mol_type = other RNA
cccgcagctcctcctgcagtt

SEQ ID NO: 2545 - RNA, 21 nt, synthetic construct
  source 1..21: mol_type = other RNA
ccccgcagctcctcctgcatt

SEQ ID NO: 2546 - RNA, 21 nt, synthetic construct
  source 1..21: mol_type = other RNA
tgctctgctccccagggagtt

SEQ ID NO: 2547 - RNA, 21 nt, synthetic construct
  source 1..21: mol_type = other RNA
gccccgcagctcctcctgctt

SEQ ID NO: 2548 - RNA, 21 nt, synthetic construct
  source 1..21: mol_type = other RNA
ggccccgcagctcctcctgtt

SEQ ID NO: 2549 - RNA, 21 nt, synthetic construct
  source 1..21: mol_type = other RNA
aggccccgcagctcctccttt

SEQ ID NO: 2550 - RNA, 21 nt, synthetic construct
  source 1..21: mol_type = other RNA
caggccccgcagctcctcctt

SEQ ID NO: 2551 - RNA, 21 nt, synthetic construct
  source 1..21: mol_type = other RNA
tcaggccccgcagctcctctt

SEQ ID NO: 2552 - RNA, 21 nt, synthetic construct
  source 1..21: mol_type = other RNA
ctcaggccccgcagctccttt

SEQ ID NO: 2553 - RNA, 21 nt, synthetic construct
  source 1..21: mol_type = other RNA
tctcaggccccgcagctcctt

SEQ ID NO: 2554 - RNA, 21 nt, synthetic construct
  source 1..21: mol_type = other RNA
ctctcaggccccgcagctctt

SEQ ID NO: 2555 - RNA, 21 nt, synthetic construct
  source 1..21: mol_type = other RNA
tctctcaggccccgcagcttt

SEQ ID NO: 2556 - RNA, 21 nt, synthetic construct
  source 1..21: mol_type = other RNA
ctctctcaggccccgcagctt

SEQ ID NO: 2557 - RNA, 21 nt, synthetic construct
  source 1..21: mol_type = other RNA
ctgctctgctccccagggatt

SEQ ID NO: 2558 - RNA, 21 nt, synthetic construct
  source 1..21: mol_type = other RNA
tctctctcaggccccgcagtt

SEQ ID NO: 2559 - RNA, 21 nt, synthetic construct
  source 1..21: mol_type = other RNA
gtctctctcaggccccgcatt

SEQ ID NO: 2560 - RNA, 21 nt, synthetic construct
  source 1..21: mol_type = other RNA
cgtctctctcaggccccgctt

SEQ ID NO: 2561 - RNA, 21 nt, synthetic construct
  source 1..21: mol_type = other RNA
acgtctctctcaggccccgtt

SEQ ID NO: 2562 - RNA, 21 nt, synthetic construct
  source 1..21: mol_type = other RNA
aacgtctctctcaggcccctt

SEQ ID NO: 2563 - RNA, 21 nt, synthetic construct
  source 1..21: mol_type = other RNA
gaacgtctctctcaggccctt

SEQ ID NO: 2564 - RNA, 21 nt, synthetic construct
  source 1..21: mol_type = other RNA
tgaacgtctctctcaggcctt

SEQ ID NO: 2565 - RNA, 21 nt, synthetic construct
  source 1..21: mol_type = other RNA
ctgaacgtctctctcaggctt

SEQ ID NO: 2566 - RNA, 21 nt, synthetic construct
  source 1..21: mol_type = other RNA
gctgaacgtctctctcaggtt

SEQ ID NO: 2567 - RNA, 21 nt, synthetic construct
  source 1..21: mol_type = other RNA
tgctgaacgtctctctcagtt

SEQ ID NO: 2568 - RNA, 21 nt, synthetic construct
  source 1..21: mol_type = other RNA
tctgctctgctccccagggtt

SEQ ID NO: 2569 - RNA, 21 nt, synthetic construct
  source 1..21: mol_type = other RNA
ttgctgaacgtctctctcatt

SEQ ID NO: 2570 - RNA, 21 nt, synthetic construct
  source 1..21: mol_type = other RNA
gttgctgaacgtctctctctt

SEQ ID NO: 2571 - RNA, 21 nt, synthetic construct
  source 1..21: mol_type = other RNA
agttgctgaacgtctctcttt

SEQ ID NO: 2572 - RNA, 21 nt, synthetic construct
  source 1..21: mol_type = other RNA
aagttgctgaacgtctctctt

SEQ ID NO: 2573 - RNA, 21 nt, synthetic construct
  source 1..21: mol_type = other RNA
gaagttgctgaacgtctcttt

SEQ ID NO: 2574 - RNA, 21 nt, synthetic construct
  source 1..21: mol_type = other RNA
tgaagttgctgaacgtctctt

SEQ ID NO: 2575 - RNA, 21 nt, synthetic construct
  source 1..21: mol_type = other RNA
tcactcttccgtgcaccgttt

SEQ ID NO: 2576 - RNA, 21 nt, synthetic construct
  source 1..21: mol_type = other RNA
gtgaagttgctgaacgtcttt

SEQ ID NO: 2577 - RNA, 21 nt, synthetic construct
  source 1..21: mol_type = other RNA
tgtgaagttgctgaacgtctt

SEQ ID NO: 2578 - RNA, 21 nt, synthetic construct
  source 1..21: mol_type = other RNA
ctgtgaagttgctgaacgttt

SEQ ID NO: 2579 - RNA, 21 nt, synthetic construct
  source 1..21: mol_type = other RNA
gctgtgaagttgctgaacgtt

SEQ ID NO: 2580 - RNA, 21 nt, synthetic construct
  source 1..21: mol_type = other RNA
ctctgctctgctccccaggtt

SEQ ID NO: 2581 - RNA, 21 nt, synthetic construct
  source 1..21: mol_type = other RNA
cgctgtgaagttgctgaactt

SEQ ID NO: 2582 - RNA, 21 nt, synthetic construct
  source 1..21: mol_type = other RNA
tcgctgtgaagttgctgaatt

SEQ ID NO: 2583 - RNA, 21 nt, synthetic construct
  source 1..21: mol_type = other RNA
ctcgctgtgaagttgctgatt

SEQ ID NO: 2584 - RNA, 21 nt, synthetic construct
  source 1..21: mol_type = other RNA
gctcgctgtgaagttgctgtt

SEQ ID NO: 2585 - RNA, 21 nt, synthetic construct
  source 1..21: mol_type = other RNA
tgctcgctgtgaagttgcttt

SEQ ID NO: 2586 - RNA, 21 nt, synthetic construct
  source 1..21: mol_type = other RNA
gtgctcgctgtgaagttgctt

SEQ ID NO: 2587 - RNA, 21 nt, synthetic construct
  source 1..21: mol_type = other RNA
cgtgctcgctgtgaagttgtt

SEQ ID NO: 2588 - RNA, 21 nt, synthetic construct
  source 1..21: mol_type = other RNA
ccgtgctcgctgtgaagtttt

SEQ ID NO: 2589 - RNA, 21 nt, synthetic construct
  source 1..21: mol_type = other RNA
tccgtgctcgctgtgaagttt

SEQ ID NO: 2590 - RNA, 21 nt, synthetic construct
  source 1..21: mol_type = other RNA
ctccgtgctcgctgtgaagtt

SEQ ID NO: 2591 - RNA, 21 nt, synthetic construct
  source 1..21: mol_type = other RNA
cctctgctctgctccccagtt

SEQ ID NO: 2592 - RNA, 21 nt, synthetic construct
  source 1..21: mol_type = other RNA
cctccgtgctcgctgtgaatt

SEQ ID NO: 2593 - RNA, 21 nt, synthetic construct
  source 1..21: mol_type = other RNA
gcctccgtgctcgctgtgatt

SEQ ID NO: 2594 - RNA, 21 nt, synthetic construct
  source 1..21: mol_type = other RNA
ggcctccgtgctcgctgtgtt

SEQ ID NO: 2595 - RNA, 21 nt, synthetic construct
  source 1..21: mol_type = other RNA
gggcctccgtgctcgctgttt

SEQ ID NO: 2596 - RNA, 21 nt, synthetic construct
  source 1..21: mol_type = other RNA
tgggcctccgtgctcgctgtt

SEQ ID NO: 2597 - RNA, 21 nt, synthetic construct
  source 1..21: mol_type = other RNA
ctgggcctccgtgctcgcttt

SEQ ID NO: 2598 - RNA, 21 nt, synthetic construct
  source 1..21: mol_type = other RNA
cctgggcctccgtgctcgctt

SEQ ID NO: 2599 - RNA, 21 nt, synthetic construct
  source 1..21: mol_type = other RNA
acctgggcctccgtgctcgtt

SEQ ID NO: 2600 - RNA, 21 nt, synthetic construct
  source 1..21: mol_type = other RNA
gacctgggcctccgtgctctt

SEQ ID NO: 2601 - RNA, 21 nt, synthetic construct
  source 1..21: mol_type = other RNA
tgacctgggcctccgtgcttt

SEQ ID NO: 2602 - RNA, 21 nt, synthetic construct
  source 1..21: mol_type = other RNA
gcctctgctctgctccccatt

SEQ ID NO: 2603 - RNA, 21 nt, synthetic construct
  source 1..21: mol_type = other RNA
ttgacctgggcctccgtgctt

SEQ ID NO: 2604 - RNA, 21 nt, synthetic construct
  source 1..21: mol_type = other RNA
cttgacctgggcctccgtgtt

SEQ ID NO: 2605 - RNA, 21 nt, synthetic construct
  source 1..21: mol_type = other RNA
ccttgacctgggcctccgttt

SEQ ID NO: 2606 - RNA, 21 nt, synthetic construct
  source 1..21: mol_type = other RNA
cccttgacctgggcctccgtt

SEQ ID NO: 2607 - RNA, 21 nt, synthetic construct
  source 1..21: mol_type = other RNA
gcccttgacctgggcctcctt

SEQ ID NO: 2608 - RNA, 21 nt, synthetic construct
  source 1..21: mol_type = other RNA
agcccttgacctgggcctctt

SEQ ID NO: 2609 - RNA, 21 nt, synthetic construct
  source 1..21: mol_type = other RNA
aagcccttgacctgggccttt

SEQ ID NO: 2610 - RNA, 21 nt, synthetic construct
  source 1..21: mol_type = other RNA
caagcccttgacctgggcctt

SEQ ID NO: 2611 - RNA, 21 nt, synthetic construct
  source 1..21: mol_type = other RNA
tcaagcccttgacctgggctt

SEQ ID NO: 2612 - RNA, 21 nt, synthetic construct
  source 1..21: mol_type = other RNA
ctcaagcccttgacctgggtt

SEQ ID NO: 2613 - RNA, 21 nt, synthetic construct
  source 1..21: mol_type = other RNA
tgcctctgctctgctcccctt

SEQ ID NO: 2614 - RNA, 21 nt, synthetic construct
  source 1..21: mol_type = other RNA
gctcaagcccttgacctggtt

SEQ ID NO: 2615 - RNA, 21 nt, synthetic construct
  source 1..21: mol_type = other RNA
tgctcaagcccttgacctgtt

SEQ ID NO: 2616 - RNA, 21 nt, synthetic construct
  source 1..21: mol_type = other RNA
gtgctcaagcccttgaccttt

SEQ ID NO: 2617 - RNA, 21 nt, synthetic construct
  source 1..21: mol_type = other RNA
ggtgctcaagcccttgacctt

SEQ ID NO: 2618 - RNA, 21 nt, synthetic construct
  source 1..21: mol_type = other RNA
gggtgctcaagcccttgactt

SEQ ID NO: 2619 - RNA, 21 nt, synthetic construct
  source 1..21: mol_type = other RNA
tgggtgctcaagcccttgatt

SEQ ID NO: 2620 - RNA, 21 nt, synthetic construct
  source 1..21: mol_type = other RNA
ctgggtgctcaagcccttgtt

SEQ ID NO: 2621 - RNA, 21 nt, synthetic construct
  source 1..21: mol_type = other RNA
cctgggtgctcaagccctttt

SEQ ID NO: 2622 - RNA, 21 nt, synthetic construct
  source 1..21: mol_type = other RNA
ccctgggtgctcaagcccttt

SEQ ID NO: 2623 - RNA, 21 nt, synthetic construct
  source 1..21: mol_type = other RNA
tccctgggtgctcaagccctt

SEQ ID NO: 2624 - RNA, 21 nt, synthetic construct
  source 1..21: mol_type = other RNA
ttgcctctgctctgctccctt

SEQ ID NO: 2625 - RNA, 21 nt, synthetic construct
  source 1..21: mol_type = other RNA
ctccctgggtgctcaagcctt

SEQ ID NO: 2626 - RNA, 21 nt, synthetic construct
  source 1..21: mol_type = other RNA
cctccctgggtgctcaagctt

SEQ ID NO: 2627 - RNA, 21 nt, synthetic construct
  source 1..21: mol_type = other RNA
gcctccctgggtgctcaagtt

SEQ ID NO: 2628 - RNA, 21 nt, synthetic construct
  source 1..21: mol_type = other RNA
tgcctccctgggtgctcaatt

SEQ ID NO: 2629 - RNA, 21 nt, synthetic construct
  source 1..21: mol_type = other RNA
ttgcctccctgggtgctcatt

SEQ ID NO: 2630 - RNA, 21 nt, synthetic construct
  source 1..21: mol_type = other RNA
attgcctccctgggtgctctt

SEQ ID NO: 2631 - RNA, 21 nt, synthetic construct
  source 1..21: mol_type = other RNA
cattgcctccctgggtgcttt

SEQ ID NO: 2632 - RNA, 21 nt, synthetic construct
  source 1..21: mol_type = other RNA
acattgcctccctgggtgctt

SEQ ID NO: 2633 - RNA, 21 nt, synthetic construct
  source 1..21: mol_type = other RNA
cacattgcctccctgggtgtt

SEQ ID NO: 2634 - RNA, 21 nt, synthetic construct
  source 1..21: mol_type = other RNA
ccacattgcctccctgggttt

SEQ ID NO: 2635 - RNA, 21 nt, synthetic construct
  source 1..21: mol_type = other RNA
gttgcctctgctctgctcctt

SEQ ID NO: 2636 - RNA, 21 nt, synthetic construct
  source 1..21: mol_type = other RNA
cccacattgcctccctgggtt

SEQ ID NO: 2637 - RNA, 21 nt, synthetic construct
  source 1..21: mol_type = other RNA
tcccacattgcctccctggtt

SEQ ID NO: 2638 - RNA, 21 nt, synthetic construct
  source 1..21: mol_type = other RNA
ttcccacattgcctccctgtt

SEQ ID NO: 2639 - RNA, 21 nt, synthetic construct
  source 1..21: mol_type = other RNA
cttcccacattgcctcccttt

SEQ ID NO: 2640 - RNA, 21 nt, synthetic construct
  source 1..21: mol_type = other RNA
tcttcccacattgcctccctt

SEQ ID NO: 2641 - RNA, 21 nt, synthetic construct
  source 1..21: mol_type = other RNA
ttcttcccacattgcctcctt

SEQ ID NO: 2642 - RNA, 21 nt, synthetic construct
  source 1..21: mol_type = other RNA
tttcttcccacattgcctctt

SEQ ID NO: 2643 - RNA, 21 nt, synthetic construct
  source 1..21: mol_type = other RNA
ctttcttcccacattgccttt

SEQ ID NO: 2644 - RNA, 21 nt, synthetic construct
  source 1..21: mol_type = other RNA
tctttcttcccacattgcctt

SEQ ID NO: 2645 - RNA, 21 nt, synthetic construct
  source 1..21: mol_type = other RNA
atctttcttcccacattgctt

SEQ ID NO: 2646 - RNA, 21 nt, synthetic construct
  source 1..21: mol_type = other RNA
ggttgcctctgctctgctctt

SEQ ID NO: 2647 - RNA, 21 nt, synthetic construct
  source 1..21: mol_type = other RNA
catctttcttcccacattgtt

SEQ ID NO: 2648 - RNA, 21 nt, synthetic construct
  source 1..21: mol_type = other RNA
tcatctttcttcccacatttt

SEQ ID NO: 2649 - RNA, 21 nt, synthetic construct
  source 1..21: mol_type = other RNA
ttcatctttcttcccacattt

SEQ ID NO: 2650 - RNA, 21 nt, synthetic construct
  source 1..21: mol_type = other RNA
cttcatctttcttcccacatt

SEQ ID NO: 2651 - RNA, 21 nt, synthetic construct
  source 1..21: mol_type = other RNA
acttcatctttcttcccactt

SEQ ID NO: 2652 - RNA, 21 nt, synthetic construct
  source 1..21: mol_type = other RNA
gacttcatctttcttcccatt

SEQ ID NO: 2653 - RNA, 21 nt, synthetic construct
  source 1..21: mol_type = other RNA
cgacttcatctttcttccctt

SEQ ID NO: 2654 - RNA, 21 nt, synthetic construct
  source 1..21: mol_type = other RNA
gcgacttcatctttcttcctt

SEQ ID NO: 2655 - RNA, 21 nt, synthetic construct
  source 1..21: mol_type = other RNA
agcgacttcatctttcttctt

SEQ ID NO: 2656 - RNA, 21 nt, synthetic construct
  source 1..21: mol_type = other RNA
tagcgacttcatctttctttt

SEQ ID NO: 2657 - RNA, 21 nt, synthetic construct
  source 1..21: mol_type = other RNA
gggttgcctctgctctgcttt

SEQ ID NO: 2658 - RNA, 21 nt, synthetic construct
  source 1..21: mol_type = other RNA
ctagcgacttcatctttcttt

SEQ ID NO: 2659 - RNA, 21 nt, synthetic construct
  source 1..21: mol_type = other RNA
tctagcgacttcatctttctt

SEQ ID NO: 2660 - RNA, 21 nt, synthetic construct
  source 1..21: mol_type = other RNA
ctctagcgacttcatcttttt

SEQ ID NO: 2661 - RNA, 21 nt, synthetic construct
  source 1..21: mol_type = other RNA
actctagcgacttcatctttt

SEQ ID NO: 2662 - RNA, 21 nt, synthetic construct
  source 1..21: mol_type = other RNA
gactctagcgacttcatcttt

SEQ ID NO: 2663 - RNA, 21 nt, synthetic construct
  source 1..21: mol_type = other RNA
ggactctagcgacttcatctt

SEQ ID NO: 2664 - RNA, 21 nt, synthetic construct
  source 1..21: mol_type = other RNA
gggactctagcgacttcattt

SEQ ID NO: 2665 - RNA, 21 nt, synthetic construct
  source 1..21: mol_type = other RNA
tgggactctagcgacttcatt

SEQ ID NO: 2666 - RNA, 21 nt, synthetic construct
  source 1..21: mol_type = other RNA
ctgggactctagcgacttctt

SEQ ID NO: 2667 - RNA, 21 nt, synthetic construct
  source 1..21: mol_type = other RNA
gctgggactctagcgactttt

SEQ ID NO: 2668 - RNA, 21 nt, synthetic construct
  source 1..21: mol_type = other RNA
agctgggactctagcgacttt

SEQ ID NO: 2669 - RNA, 21 nt, synthetic construct
  source 1..21: mol_type = other RNA
tgggttgcctctgctctgctt

SEQ ID NO: 2670 - RNA, 21 nt, synthetic construct
  source 1..21: mol_type = other RNA
cagctgggactctagcgactt

SEQ ID NO: 2671 - RNA, 21 nt, synthetic construct
  source 1..21: mol_type = other RNA
ccagctgggactctagcgatt

SEQ ID NO: 2672 - RNA, 21 nt, synthetic construct
  source 1..21: mol_type = other RNA
tccagctgggactctagcgtt

SEQ ID NO: 2673 - RNA, 21 nt, synthetic construct
  source 1..21: mol_type = other RNA
ctccagctgggactctagctt

SEQ ID NO: 2674 - RNA, 21 nt, synthetic construct
  source 1..21: mol_type = other RNA
tctccagctgggactctagtt

SEQ ID NO: 2675 - RNA, 21 nt, synthetic construct
  source 1..21: mol_type = other RNA
ttctccagctgggactctatt

SEQ ID NO: 2676 - RNA, 21 nt, synthetic construct
  source 1..21: mol_type = other RNA
tttctccagctgggactcttt

SEQ ID NO: 2677 - RNA, 21 nt, synthetic construct
  source 1..21: mol_type = other RNA
gtttctccagctgggactctt

SEQ ID NO: 2678 - RNA, 21 nt, synthetic construct
  source 1..21: mol_type = other RNA
tgtttctccagctgggacttt

SEQ ID NO: 2679 - RNA, 21 nt, synthetic construct
  source 1..21: mol_type = other RNA
ctgtttctccagctgggactt

SEQ ID NO: 2680 - RNA, 21 nt, synthetic construct
  source 1..21: mol_type = other RNA
atgggttgcctctgctctgtt

SEQ ID NO: 2681 - RNA, 21 nt, synthetic construct
  source 1..21: mol_type = other RNA
gctgtttctccagctgggatt

SEQ ID NO: 2682 - RNA, 21 nt, synthetic construct
  source 1..21: mol_type = other RNA
tgctgtttctccagctgggtt

SEQ ID NO: 2683 - RNA, 21 nt, synthetic construct
  source 1..21: mol_type = other RNA
ctgctgtttctccagctggtt

SEQ ID NO: 2684 - RNA, 21 nt, synthetic construct
  source 1..21: mol_type = other RNA
tctgctgtttctccagctgtt

SEQ ID NO: 2685 - RNA, 21 nt, synthetic construct
  source 1..21: mol_type = other RNA
ttctgctgtttctccagcttt

SEQ ID NO: 2686 - RNA, 21 nt, synthetic construct
  source 1..21: mol_type = other RNA
cttctgctgtttctccagctt

SEQ ID NO: 2687 - RNA, 21 nt, synthetic construct
  source 1..21: mol_type = other RNA
ctcactcttccgtgcaccgtt

SEQ ID NO: 2688 - RNA, 21 nt, synthetic construct
  source 1..21: mol_type = other RNA
ccttctgctgtttctccagtt

SEQ ID NO: 2689 - RNA, 21 nt, synthetic construct
  source 1..21: mol_type = other RNA
tccttctgctgtttctccatt

SEQ ID NO: 2690 - RNA, 21 nt, synthetic construct
  source 1..21: mol_type = other RNA
gtccttctgctgtttctcctt

SEQ ID NO: 2691 - RNA, 21 nt, synthetic construct
  source 1..21: mol_type = other RNA
ggtccttctgctgtttctctt

SEQ ID NO: 2692 - RNA, 21 nt, synthetic construct
  source 1..21: mol_type = other RNA
gatgggttgcctctgctcttt

SEQ ID NO: 2693 - RNA, 21 nt, synthetic construct
  source 1..21: mol_type = other RNA
aggtccttctgctgtttcttt

SEQ ID NO: 2694 - RNA, 21 nt, synthetic construct
  source 1..21: mol_type = other RNA
caggtccttctgctgtttctt

SEQ ID NO: 2695 - RNA, 21 nt, synthetic construct
  source 1..21: mol_type = other RNA
tcaggtccttctgctgttttt

SEQ ID NO: 2696 - RNA, 21 nt, synthetic construct
  source 1..21: mol_type = other RNA
ctcaggtccttctgctgtttt

SEQ ID NO: 2697 - RNA, 21 nt, synthetic construct
  source 1..21: mol_type = other RNA
actcaggtccttctgctgttt

SEQ ID NO: 2698 - RNA, 21 nt, synthetic construct
  source 1..21: mol_type = other RNA
cactcaggtccttctgctgtt

SEQ ID NO: 2699 - RNA, 21 nt, synthetic construct
  source 1..21: mol_type = other RNA
tcactcaggtccttctgcttt

SEQ ID NO: 2700 - RNA, 21 nt, synthetic construct
  source 1..21: mol_type = other RNA
ttcactcaggtccttctgctt

SEQ ID NO: 2701 - RNA, 21 nt, synthetic construct
  source 1..21: mol_type = other RNA
cttcactcaggtccttctgtt

SEQ ID NO: 2702 - RNA, 21 nt, synthetic construct
  source 1..21: mol_type = other RNA
tcttcactcaggtccttcttt

SEQ ID NO: 2703 - RNA, 21 nt, synthetic construct
  source 1..21: mol_type = other RNA
ggatgggttgcctctgctctt

SEQ ID NO: 2704 - RNA, 21 nt, synthetic construct
  source 1..21: mol_type = other RNA
atcttcactcaggtccttctt

SEQ ID NO: 2705 - RNA, 21 nt, synthetic construct
  source 1..21: mol_type = other RNA
gatcttcactcaggtcctttt

SEQ ID NO: 2706 - RNA, 21 nt, synthetic construct
  source 1..21: mol_type = other RNA
tgatcttcactcaggtccttt

SEQ ID NO: 2707 - RNA, 21 nt, synthetic construct
  source 1..21: mol_type = other RNA
gtgatcttcactcaggtcctt

SEQ ID NO: 2708 - RNA, 21 nt, synthetic construct
  source 1..21: mol_type = other RNA
agtgatcttcactcaggtctt

SEQ ID NO: 2709 - RNA, 21 nt, synthetic construct
  source 1..21: mol_type = other RNA
gagtgatcttcactcaggttt

SEQ ID NO: 2710 - RNA, 21 nt, synthetic construct
  source 1..21: mol_type = other RNA
ggagtgatcttcactcaggtt

SEQ ID NO: 2711 - RNA, 21 nt, synthetic construct
  source 1..21: mol_type = other RNA
tggagtgatcttcactcagtt

SEQ ID NO: 2712 - RNA, 21 nt, synthetic construct
  source 1..21: mol_type = other RNA
ctggagtgatcttcactcatt

SEQ ID NO: 2713 - RNA, 21 nt, synthetic construct
  source 1..21: mol_type = other RNA
gctggagtgatcttcactctt

SEQ ID NO: 2714 - RNA, 21 nt, synthetic construct
  source 1..21: mol_type = other RNA
gggatgggttgcctctgcttt

SEQ ID NO: 2715 - RNA, 21 nt, synthetic construct
  source 1..21: mol_type = other RNA
ggctggagtgatcttcacttt

SEQ ID NO: 2716 - RNA, 21 nt, synthetic construct
  source 1..21: mol_type = other RNA
aggctggagtgatcttcactt

SEQ ID NO: 2717 - RNA, 21 nt, synthetic construct
  source 1..21: mol_type = other RNA
caggctggagtgatcttcatt

SEQ ID NO: 2718 - RNA, 21 nt, synthetic construct
  source 1..21: mol_type = other RNA
gcaggctggagtgatcttctt

SEQ ID NO: 2719 - RNA, 21 nt, synthetic construct
  source 1..21: mol_type = other RNA
agcaggctggagtgatctttt

SEQ ID NO: 2720 - RNA, 21 nt, synthetic construct
  source 1..21: mol_type = other RNA
cagcaggctggagtgatcttt

SEQ ID NO: 2721 - RNA, 21 nt, synthetic construct
  source 1..21: mol_type = other RNA
gcagcaggctggagtgatctt

SEQ ID NO: 2722 - RNA, 21 nt, synthetic construct
  source 1..21: mol_type = other RNA
agcagcaggctggagtgattt

SEQ ID NO: 2723 - RNA, 21 nt, synthetic construct
  source 1..21: mol_type = other RNA
gagcagcaggctggagtgatt

SEQ ID NO: 2724 - RNA, 21 nt, synthetic construct
  source 1..21: mol_type = other RNA
ggagcagcaggctggagtgtt

SEQ ID NO: 2725 - RNA, 21 nt, synthetic construct
  source 1..21: mol_type = other RNA
ggggatgggttgcctctgctt

SEQ ID NO: 2726 - RNA, 21 nt, synthetic construct
  source 1..21: mol_type = other RNA
tggagcagcaggctggagttt

SEQ ID NO: 2727 - RNA, 21 nt, synthetic construct
  source 1..21: mol_type = other RNA
gtggagcagcaggctggagtt

SEQ ID NO: 2728 - RNA, 21 nt, synthetic construct
  source 1..21: mol_type = other RNA
cgtggagcagcaggctggatt

SEQ ID NO: 2729 - RNA, 21 nt, synthetic construct
  source 1..21: mol_type = other RNA
acgtggagcagcaggctggtt

SEQ ID NO: 2730 - RNA, 21 nt, synthetic construct
  source 1..21: mol_type = other RNA
cacgtggagcagcaggctgtt

SEQ ID NO: 2731 - RNA, 21 nt, synthetic construct
  source 1..21: mol_type = other RNA
tcacgtggagcagcaggcttt

SEQ ID NO: 2732 - RNA, 21 nt, synthetic construct
  source 1..21: mol_type = other RNA
ttcacgtggagcagcaggctt

SEQ ID NO: 2733 - RNA, 21 nt, synthetic construct
  source 1..21: mol_type = other RNA
cttcacgtggagcagcaggtt

SEQ ID NO: 2734 - RNA, 21 nt, synthetic construct
  source 1..21: mol_type = other RNA
gcttcacgtggagcagcagtt

SEQ ID NO: 2735 - RNA, 21 nt, synthetic construct
  source 1..21: mol_type = other RNA
tgcttcacgtggagcagcatt

SEQ ID NO: 2736 - RNA, 21 nt, synthetic construct
  source 1..21: mol_type = other RNA
gggggatgggttgcctctgtt

SEQ ID NO: 2737 - RNA, 21 nt, synthetic construct
  source 1..21: mol_type = other RNA
ctgcttcacgtggagcagctt

SEQ ID NO: 2738 - RNA, 21 nt, synthetic construct
  source 1..21: mol_type = other RNA
actgcttcacgtggagcagtt

SEQ ID NO: 2739 - RNA, 21 nt, synthetic construct
  source 1..21: mol_type = other RNA
aactgcttcacgtggagcatt

SEQ ID NO: 2740 - RNA, 21 nt, synthetic construct
  source 1..21: mol_type = other RNA
gaactgcttcacgtggagctt

SEQ ID NO: 2741 - RNA, 21 nt, synthetic construct
  source 1..21: mol_type = other RNA
cgaactgcttcacgtggagtt

SEQ ID NO: 2742 - RNA, 21 nt, synthetic construct
  source 1..21: mol_type = other RNA
acgaactgcttcacgtggatt

SEQ ID NO: 2743 - RNA, 21 nt, synthetic construct
  source 1..21: mol_type = other RNA
cacgaactgcttcacgtggtt

SEQ ID NO: 2744 - RNA, 21 nt, synthetic construct
  source 1..21: mol_type = other RNA
acacgaactgcttcacgtgtt

SEQ ID NO: 2745 - RNA, 21 nt, synthetic construct
  source 1..21: mol_type = other RNA
gacacgaactgcttcacgttt

SEQ ID NO: 2746 - RNA, 21 nt, synthetic construct
  source 1..21: mol_type = other RNA
agacacgaactgcttcacgtt

SEQ ID NO: 2747 - RNA, 21 nt, synthetic construct
  source 1..21: mol_type = other RNA
tgggggatgggttgcctcttt

SEQ ID NO: 2748 - RNA, 21 nt, synthetic construct
  source 1..21: mol_type = other RNA
cagacacgaactgcttcactt

SEQ ID NO: 2749 - RNA, 21 nt, synthetic construct
  source 1..21: mol_type = other RNA
tcagacacgaactgcttcatt

SEQ ID NO: 2750 - RNA, 21 nt, synthetic construct
  source 1..21: mol_type = other RNA
gtcagacacgaactgcttctt

SEQ ID NO: 2751 - RNA, 21 nt, synthetic construct
  source 1..21: mol_type = other RNA
ggtcagacacgaactgctttt

SEQ ID NO: 2752 - RNA, 21 nt, synthetic construct
  source 1..21: mol_type = other RNA
aggtcagacacgaactgcttt

SEQ ID NO: 2753 - RNA, 21 nt, synthetic construct
  source 1..21: mol_type = other RNA
caggtcagacacgaactgctt

SEQ ID NO: 2754 - RNA, 21 nt, synthetic construct
  source 1..21: mol_type = other RNA
gcaggtcagacacgaactgtt

SEQ ID NO: 2755 - RNA, 21 nt, synthetic construct
  source 1..21: mol_type = other RNA
cgcaggtcagacacgaacttt

SEQ ID NO: 2756 - RNA, 21 nt, synthetic construct
  source 1..21: mol_type = other RNA
ccgcaggtcagacacgaactt

SEQ ID NO: 2757 - RNA, 21 nt, synthetic construct
  source 1..21: mol_type = other RNA
tccgcaggtcagacacgaatt

SEQ ID NO: 2758 - RNA, 21 nt, synthetic construct
  source 1..21: mol_type = other RNA
gtgggggatgggttgcctctt

SEQ ID NO: 2759 - RNA, 21 nt, synthetic construct
  source 1..21: mol_type = other RNA
ctccgcaggtcagacacgatt

SEQ ID NO: 2760 - RNA, 21 nt, synthetic construct
  source 1..21: mol_type = other RNA
gctccgcaggtcagacacgtt

SEQ ID NO: 2761 - RNA, 21 nt, synthetic construct
  source 1..21: mol_type = other RNA
ggctccgcaggtcagacactt

SEQ ID NO: 2762 - RNA, 21 nt, synthetic construct
  source 1..21: mol_type = other RNA
aggctccgcaggtcagacatt

SEQ ID NO: 2763 - RNA, 21 nt, synthetic construct
  source 1..21: mol_type = other RNA
caggctccgcaggtcagactt

SEQ ID NO: 2764 - RNA, 21 nt, synthetic construct
  source 1..21: mol_type = other RNA
tcaggctccgcaggtcagatt

SEQ ID NO: 2765 - RNA, 21 nt, synthetic construct
  source 1..21: mol_type = other RNA
ctcaggctccgcaggtcagtt

SEQ ID NO: 2766 - RNA, 21 nt, synthetic construct
  source 1..21: mol_type = other RNA
gctcaggctccgcaggtcatt

SEQ ID NO: 2767 - RNA, 21 nt, synthetic construct
  source 1..21: mol_type = other RNA
agctcaggctccgcaggtctt

SEQ ID NO: 2768 - RNA, 21 nt, synthetic construct
  source 1..21: mol_type = other RNA
cagctcaggctccgcaggttt

SEQ ID NO: 2769 - RNA, 21 nt, synthetic construct
  source 1..21: mol_type = other RNA
agtgggggatgggttgccttt

SEQ ID NO: 2770 - RNA, 21 nt, synthetic construct
  source 1..21: mol_type = other RNA
acagctcaggctccgcaggtt

SEQ ID NO: 2771 - RNA, 21 nt, synthetic construct
  source 1..21: mol_type = other RNA
gacagctcaggctccgcagtt

SEQ ID NO: 2772 - RNA, 21 nt, synthetic construct
  source 1..21: mol_type = other RNA
tgacagctcaggctccgcatt

SEQ ID NO: 2773 - RNA, 21 nt, synthetic construct
  source 1..21: mol_type = other RNA
ctgacagctcaggctccgctt

SEQ ID NO: 2774 - RNA, 21 nt, synthetic construct
  source 1..21: mol_type = other RNA
tctgacagctcaggctccgtt

SEQ ID NO: 2775 - RNA, 21 nt, synthetic construct
  source 1..21: mol_type = other RNA
atctgacagctcaggctcctt

SEQ ID NO: 2776 - RNA, 21 nt, synthetic construct
  source 1..21: mol_type = other RNA
catctgacagctcaggctctt

SEQ ID NO: 2777 - RNA, 21 nt, synthetic construct
  source 1..21: mol_type = other RNA
ccatctgacagctcaggcttt

SEQ ID NO: 2778 - RNA, 21 nt, synthetic construct
  source 1..21: mol_type = other RNA
gccatctgacagctcaggctt

SEQ ID NO: 2779 - RNA, 21 nt, synthetic construct
  source 1..21: mol_type = other RNA
cgccatctgacagctcaggtt

SEQ ID NO: 2780 - RNA, 21 nt, synthetic construct
  source 1..21: mol_type = other RNA
gagtgggggatgggttgcctt

SEQ ID NO: 2781 - RNA, 21 nt, synthetic construct
  source 1..21: mol_type = other RNA
ccgccatctgacagctcagtt

SEQ ID NO: 2782 - RNA, 21 nt, synthetic construct
  source 1..21: mol_type = other RNA
gccgccatctgacagctcatt

SEQ ID NO: 2783 - RNA, 21 nt, synthetic construct
  source 1..21: mol_type = other RNA
cgccgccatctgacagctctt

SEQ ID NO: 2784 - RNA, 21 nt, synthetic construct
  source 1..21: mol_type = other RNA
gcgccgccatctgacagcttt

SEQ ID NO: 2785 - RNA, 21 nt, synthetic construct
  source 1..21: mol_type = other RNA
agcgccgccatctgacagctt

SEQ ID NO: 2786 - RNA, 21 nt, synthetic construct
  source 1..21: mol_type = other RNA
gagcgccgccatctgacagtt

SEQ ID NO: 2787 - RNA, 21 nt, synthetic construct
  source 1..21: mol_type = other RNA
ggagcgccgccatctgacatt

SEQ ID NO: 2788 - RNA, 21 nt, synthetic construct
  source 1..21: mol_type = other RNA
tggagcgccgccatctgactt

SEQ ID NO: 2789 - RNA, 21 nt, synthetic construct
  source 1..21: mol_type = other RNA
ctggagcgccgccatctgatt

SEQ ID NO: 2790 - RNA, 21 nt, synthetic construct
  source 1..21: mol_type = other RNA
cctggagcgccgccatctgtt

SEQ ID NO: 2791 - RNA, 21 nt, synthetic construct
  source 1..21: mol_type = other RNA
ccctggagcgccgccatcttt

SEQ ID NO: 2792 - RNA, 21 nt, synthetic construct
  source 1..21: mol_type = other RNA
ggagtgggggatgggttgctt

SEQ ID NO: 2793 - RNA, 21 nt, synthetic construct
  source 1..21: mol_type = other RNA
gccctggagcgccgccatctt

SEQ ID NO: 2794 - RNA, 21 nt, synthetic construct
  source 1..21: mol_type = other RNA
gggagtgggggatgggttgtt

SEQ ID NO: 2795 - RNA, 21 nt, synthetic construct
  source 1..21: mol_type = other RNA
tgccctggagcgccgccattt

SEQ ID NO: 2796 - RNA, 21 nt, synthetic construct
  source 1..21: mol_type = other RNA
ttgccctggagcgccgccatt

SEQ ID NO: 2797 - RNA, 21 nt, synthetic construct
  source 1..21: mol_type = other RNA
attgccctggagcgccgcctt

SEQ ID NO: 2798 - RNA, 21 nt, synthetic construct
  source 1..21: mol_type = other RNA
cattgccctggagcgccgctt

SEQ ID NO: 2799 - RNA, 21 nt, synthetic construct
  source 1..21: mol_type = other RNA
ccattgccctggagcgccgtt

SEQ ID NO: 2800 - RNA, 21 nt, synthetic construct
  source 1..21: mol_type = other RNA
cctcactcttccgtgcacctt

SEQ ID NO: 2801 - RNA, 21 nt, synthetic construct
  source 1..21: mol_type = other RNA
gccattgccctggagcgcctt

SEQ ID NO: 2802 - RNA, 21 nt, synthetic construct
  source 1..21: mol_type = other RNA
agccattgccctggagcgctt

SEQ ID NO: 2803 - RNA, 21 nt, synthetic construct
  source 1..21: mol_type = other RNA
gagccattgccctggagcgtt

SEQ ID NO: 2804 - RNA, 21 nt, synthetic construct
  source 1..21: mol_type = other RNA
tgagccattgccctggagctt

SEQ ID NO: 2805 - RNA, 21 nt, synthetic construct
  source 1..21: mol_type = other RNA
ctgagccattgccctggagtt

SEQ ID NO: 2806 - RNA, 21 nt, synthetic construct
  source 1..21: mol_type = other RNA
tgggagtgggggatgggtttt

SEQ ID NO: 2807 - RNA, 21 nt, synthetic construct
  source 1..21: mol_type = other RNA
tctgagccattgccctggatt

SEQ ID NO: 2808 - RNA, 21 nt, synthetic construct
  source 1..21: mol_type = other RNA
ttctgagccattgccctggtt

SEQ ID NO: 2809 - RNA, 21 nt, synthetic construct
  source 1..21: mol_type = other RNA
tttctgagccattgccctgtt

SEQ ID NO: 2810 - RNA, 21 nt, synthetic construct
  source 1..21: mol_type = other RNA
ctttctgagccattgcccttt

SEQ ID NO: 2811 - RNA, 21 nt, synthetic construct
  source 1..21: mol_type = other RNA
cctttctgagccattgccctt

SEQ ID NO: 2812 - RNA, 21 nt, synthetic construct
  source 1..21: mol_type = other RNA
tcctttctgagccattgcctt

SEQ ID NO: 2813 - RNA, 21 nt, synthetic construct
  source 1..21: mol_type = other RNA
gtcctttctgagccattgctt

SEQ ID NO: 2814 - RNA, 21 nt, synthetic construct
  source 1..21: mol_type = other RNA
ggtcctttctgagccattgtt

SEQ ID NO: 2815 - RNA, 21 nt, synthetic construct
  source 1..21: mol_type = other RNA
aggtcctttctgagccatttt

SEQ ID NO: 2816 - RNA, 21 nt, synthetic construct
  source 1..21: mol_type = other RNA
caggtcctttctgagccattt

SEQ ID NO: 2817 - RNA, 21 nt, synthetic construct
  source 1..21: mol_type = other RNA
gtgggagtgggggatgggttt

SEQ ID NO: 2818 - RNA, 21 nt, synthetic construct
  source 1..21: mol_type = other RNA
gcaggtcctttctgagccatt

SEQ ID NO: 2819 - RNA, 21 nt, synthetic construct
  source 1..21: mol_type = other RNA
agcaggtcctttctgagcctt

SEQ ID NO: 2820 - RNA, 21 nt, synthetic construct
  source 1..21: mol_type = other RNA
cagcaggtcctttctgagctt

SEQ ID NO: 2821 - RNA, 21 nt, synthetic construct
  source 1..21: mol_type = other RNA
gcagcaggtcctttctgagtt

SEQ ID NO: 2822 - RNA, 21 nt, synthetic construct
  source 1..21: mol_type = other RNA
ggcagcaggtcctttctgatt

SEQ ID NO: 2823 - RNA, 21 nt, synthetic construct
  source 1..21: mol_type = other RNA
gggcagcaggtcctttctgtt

SEQ ID NO: 2824 - RNA, 21 nt, synthetic construct
  source 1..21: mol_type = other RNA
cgggcagcaggtcctttcttt

SEQ ID NO: 2825 - RNA, 21 nt, synthetic construct
  source 1..21: mol_type = other RNA
ccgggcagcaggtcctttctt

SEQ ID NO: 2826 - RNA, 21 nt, synthetic construct
  source 1..21: mol_type = other RNA
accgggcagcaggtccttttt

SEQ ID NO: 2827 - RNA, 21 nt, synthetic construct
  source 1..21: mol_type = other RNA
gaccgggcagcaggtcctttt

SEQ ID NO: 2828 - RNA, 21 nt, synthetic construct
  source 1..21: mol_type = other RNA
ggtgggagtgggggatgggtt

SEQ ID NO: 2829 - RNA, 21 nt, synthetic construct
  source 1..21: mol_type = other RNA
tgaccgggcagcaggtccttt

SEQ ID NO: 2830 - RNA, 21 nt, synthetic construct
  source 1..21: mol_type = other RNA
ttgaccgggcagcaggtcctt

SEQ ID NO: 2831 - RNA, 21 nt, synthetic construct
  source 1..21: mol_type = other RNA
gttgaccgggcagcaggtctt

SEQ ID NO: 2832 - RNA, 21 nt, synthetic construct
  source 1..21: mol_type = other RNA
agttgaccgggcagcaggttt

SEQ ID NO: 2833 - RNA, 21 nt, synthetic construct
  source 1..21: mol_type = other RNA
cagttgaccgggcagcaggtt

SEQ ID NO: 2834 - RNA, 21 nt, synthetic construct
  source 1..21: mol_type = other RNA
ccagttgaccgggcagcagtt

SEQ ID NO: 2835 - RNA, 21 nt, synthetic construct
  source 1..21: mol_type = other RNA
cccagttgaccgggcagcatt

SEQ ID NO: 2836 - RNA, 21 nt, synthetic construct
  source 1..21: mol_type = other RNA
acccagttgaccgggcagctt

SEQ ID NO: 2837 - RNA, 21 nt, synthetic construct
  source 1..21: mol_type = other RNA
cacccagttgaccgggcagtt

SEQ ID NO: 2838 - RNA, 21 nt, synthetic construct
  source 1..21: mol_type = other RNA
ccacccagttgaccgggcatt

SEQ ID NO: 2839 - RNA, 21 nt, synthetic construct
  source 1..21: mol_type = other RNA
gggtgggagtgggggatggtt

SEQ ID NO: 2840 - RNA, 21 nt, synthetic construct
  source 1..21: mol_type = other RNA
tccacccagttgaccgggctt

SEQ ID NO: 2841 - RNA, 21 nt, synthetic construct
  source 1..21: mol_type = other RNA
ctccacccagttgaccgggtt

SEQ ID NO: 2842 - RNA, 21 nt, synthetic construct
  source 1..21: mol_type = other RNA
gctccacccagttgaccggtt

SEQ ID NO: 2843 - RNA, 21 nt, synthetic construct
  source 1..21: mol_type = other RNA
tgctccacccagttgaccgtt

SEQ ID NO: 2844 - RNA, 21 nt, synthetic construct
  source 1..21: mol_type = other RNA
gtgctccacccagttgacctt

SEQ ID NO: 2845 - RNA, 21 nt, synthetic construct
  source 1..21: mol_type = other RNA
cgtgctccacccagttgactt

SEQ ID NO: 2846 - RNA, 21 nt, synthetic construct
  source 1..21: mol_type = other RNA
tcgtgctccacccagttgatt

SEQ ID NO: 2847 - RNA, 21 nt, synthetic construct
  source 1..21: mol_type = other RNA
ctcgtgctccacccagttgtt

SEQ ID NO: 2848 - RNA, 21 nt, synthetic construct
  source 1..21: mol_type = other RNA
gctcgtgctccacccagtttt

SEQ ID NO: 2849 - RNA, 21 nt, synthetic construct
  source 1..21: mol_type = other RNA
cgctcgtgctccacccagttt

SEQ ID NO: 2850 - RNA, 21 nt, synthetic construct
  source 1..21: mol_type = other RNA
ggggtgggagtgggggatgtt

SEQ ID NO: 2851 - RNA, 21 nt, synthetic construct
  source 1..21: mol_type = other RNA
gcgctcgtgctccacccagtt

SEQ ID NO: 2852 - RNA, 21 nt, synthetic construct
  source 1..21: mol_type = other RNA
tgcgctcgtgctccacccatt

SEQ ID NO: 2853 - RNA, 21 nt, synthetic construct
  source 1..21: mol_type = other RNA
ctgcgctcgtgctccaccctt

SEQ ID NO: 2854 - RNA, 21 nt, synthetic construct
  source 1..21: mol_type = other RNA
gctgcgctcgtgctccacctt

SEQ ID NO: 2855 - RNA, 21 nt, synthetic construct
  source 1..21: mol_type = other RNA
agctgcgctcgtgctccactt

SEQ ID NO: 2856 - RNA, 21 nt, synthetic construct
  source 1..21: mol_type = other RNA
cagctgcgctcgtgctccatt

SEQ ID NO: 2857 - RNA, 21 nt, synthetic construct
  source 1..21: mol_type = other RNA
gcagctgcgctcgtgctcctt

SEQ ID NO: 2858 - RNA, 21 nt, synthetic construct
  source 1..21: mol_type = other RNA
agcagctgcgctcgtgctctt

SEQ ID NO: 2859 - RNA, 21 nt, synthetic construct
  source 1..21: mol_type = other RNA
tagcagctgcgctcgtgcttt

SEQ ID NO: 2860 - RNA, 21 nt, synthetic construct
  source 1..21: mol_type = other RNA
gtagcagctgcgctcgtgctt

SEQ ID NO: 2861 - RNA, 21 nt, synthetic construct
  source 1..21: mol_type = other RNA
gggggtgggagtgggggattt

SEQ ID NO: 2862 - RNA, 21 nt, synthetic construct
  source 1..21: mol_type = other RNA
agtagcagctgcgctcgtgtt

SEQ ID NO: 2863 - RNA, 21 nt, synthetic construct
  source 1..21: mol_type = other RNA
cagtagcagctgcgctcgttt

SEQ ID NO: 2864 - RNA, 21 nt, synthetic construct
  source 1..21: mol_type = other RNA
ccagtagcagctgcgctcgtt

SEQ ID NO: 2865 - RNA, 21 nt, synthetic construct
  source 1..21: mol_type = other RNA
accagtagcagctgcgctctt

SEQ ID NO: 2866 - RNA, 21 nt, synthetic construct
  source 1..21: mol_type = other RNA
aaccagtagcagctgcgcttt

SEQ ID NO: 2867 - RNA, 21 nt, synthetic construct
  source 1..21: mol_type = other RNA
gaaccagtagcagctgcgctt

SEQ ID NO: 2868 - RNA, 21 nt, synthetic construct
  source 1..21: mol_type = other RNA
agaaccagtagcagctgcgtt

SEQ ID NO: 2869 - RNA, 21 nt, synthetic construct
  source 1..21: mol_type = other RNA
gagaaccagtagcagctgctt

SEQ ID NO: 2870 - RNA, 21 nt, synthetic construct
  source 1..21: mol_type = other RNA
agagaaccagtagcagctgtt

SEQ ID NO: 2871 - RNA, 21 nt, synthetic construct
  source 1..21: mol_type = other RNA
gagagaaccagtagcagcttt

SEQ ID NO: 2872 - RNA, 21 nt, synthetic construct
  source 1..21: mol_type = other RNA
tgggggtgggagtgggggatt

SEQ ID NO: 2873 - RNA, 21 nt, synthetic construct
  source 1..21: mol_type = other RNA
cgagagaaccagtagcagctt

SEQ ID NO: 2874 - RNA, 21 nt, synthetic construct
  source 1..21: mol_type = other RNA
gcgagagaaccagtagcagtt

SEQ ID NO: 2875 - RNA, 21 nt, synthetic construct
  source 1..21: mol_type = other RNA
agcgagagaaccagtagcatt

SEQ ID NO: 2876 - RNA, 21 nt, synthetic construct
  source 1..21: mol_type = other RNA
gagcgagagaaccagtagctt

SEQ ID NO: 2877 - RNA, 21 nt, synthetic construct
  source 1..21: mol_type = other RNA
ggagcgagagaaccagtagtt

SEQ ID NO: 2878 - RNA, 21 nt, synthetic construct
  source 1..21: mol_type = other RNA
cggagcgagagaaccagtatt

SEQ ID NO: 2879 - RNA, 21 nt, synthetic construct
  source 1..21: mol_type = other RNA
ccggagcgagagaaccagttt

SEQ ID NO: 2880 - RNA, 21 nt, synthetic construct
  source 1..21: mol_type = other RNA
cccggagcgagagaaccagtt

SEQ ID NO: 2881 - RNA, 21 nt, synthetic construct
  source 1..21: mol_type = other RNA
tcccggagcgagagaaccatt

SEQ ID NO: 2882 - RNA, 21 nt, synthetic construct
  source 1..21: mol_type = other RNA
ttcccggagcgagagaacctt

SEQ ID NO: 2883 - RNA, 21 nt, synthetic construct
  source 1..21: mol_type = other RNA
gtgggggtgggagtgggggtt

SEQ ID NO: 2884 - RNA, 21 nt, synthetic construct
  source 1..21: mol_type = other RNA
cttcccggagcgagagaactt

SEQ ID NO: 2885 - RNA, 21 nt, synthetic construct
  source 1..21: mol_type = other RNA
ccttcccggagcgagagaatt

SEQ ID NO: 2886 - RNA, 21 nt, synthetic construct
  source 1..21: mol_type = other RNA
gccttcccggagcgagagatt

SEQ ID NO: 2887 - RNA, 21 nt, synthetic construct
  source 1..21: mol_type = other RNA
ggccttcccggagcgagagtt

SEQ ID NO: 2888 - RNA, 21 nt, synthetic construct
  source 1..21: mol_type = other RNA
aggccttcccggagcgagatt

SEQ ID NO: 2889 - RNA, 21 nt, synthetic construct
  source 1..21: mol_type = other RNA
caggccttcccggagcgagtt

SEQ ID NO: 2890 - RNA, 21 nt, synthetic construct
  source 1..21: mol_type = other RNA
ccaggccttcccggagcgatt

SEQ ID NO: 2891 - RNA, 21 nt, synthetic construct
  source 1..21: mol_type = other RNA
cccaggccttcccggagcgtt

SEQ ID NO: 2892 - RNA, 21 nt, synthetic construct
  source 1..21: mol_type = other RNA
gcccaggccttcccggagctt

SEQ ID NO: 2893 - RNA, 21 nt, synthetic construct
  source 1..21: mol_type = other RNA
agcccaggccttcccggagtt

SEQ ID NO: 2894 - RNA, 21 nt, synthetic construct
  source 1..21: mol_type = other RNA
tgtgggggtgggagtggggtt

SEQ ID NO: 2895 - RNA, 21 nt, synthetic construct
  source 1..21: mol_type = other RNA
cagcccaggccttcccggatt

SEQ ID NO: 2896 - RNA, 21 nt, synthetic construct
  source 1..21: mol_type = other RNA
tcagcccaggccttcccggtt

SEQ ID NO: 2897 - RNA, 21 nt, synthetic construct
  source 1..21: mol_type = other RNA
gtcagcccaggccttcccgtt

SEQ ID NO: 2898 - RNA, 21 nt, synthetic construct
  source 1..21: mol_type = other RNA
cgtcagcccaggccttccctt

SEQ ID NO: 2899 - RNA, 21 nt, synthetic construct
  source 1..21: mol_type = other RNA
gcgtcagcccaggccttcctt

SEQ ID NO: 2900 - RNA, 21 nt, synthetic construct
  source 1..21: mol_type = other RNA
ggcgtcagcccaggccttctt

SEQ ID NO: 2901 - RNA, 21 nt, synthetic construct
  source 1..21: mol_type = other RNA
cggcgtcagcccaggcctttt

SEQ ID NO: 2902 - RNA, 21 nt, synthetic construct
  source 1..21: mol_type = other RNA
tcggcgtcagcccaggccttt

SEQ ID NO: 2903 - RNA, 21 nt, synthetic construct
  source 1..21: mol_type = other RNA
gtcggcgtcagcccaggcctt

SEQ ID NO: 2904 - RNA, 21 nt, synthetic construct
  source 1..21: mol_type = other RNA
tgtcggcgtcagcccaggctt

SEQ ID NO: 2905 - RNA, 21 nt, synthetic construct
  source 1..21: mol_type = other RNA
gtgtgggggtgggagtgggtt

SEQ ID NO: 2906 - RNA, 21 nt, synthetic construct
  source 1..21: mol_type = other RNA
ttgtcggcgtcagcccaggtt

SEQ ID NO: 2907 - RNA, 21 nt, synthetic construct
  source 1..21: mol_type = other RNA
gttgtcggcgtcagcccagtt

SEQ ID NO: 2908 - RNA, 21 nt, synthetic construct
  source 1..21: mol_type = other RNA
agttgtcggcgtcagcccatt

SEQ ID NO: 2909 - RNA, 21 nt, synthetic construct
  source 1..21: mol_type = other RNA
tagttgtcggcgtcagccctt

SEQ ID NO: 2910 - RNA, 21 nt, synthetic construct
  source 1..21: mol_type = other RNA
gtagttgtcggcgtcagcctt

SEQ ID NO: 2911 - RNA, 21 nt, synthetic construct
  source 1..21: mol_type = other RNA
agtagttgtcggcgtcagctt

SEQ ID NO: 2912 - RNA, 21 nt, synthetic construct
  source 1..21: mol_type = other RNA
acctcactcttccgtgcactt

SEQ ID NO: 2913 - RNA, 21 nt, synthetic construct
  source 1..21: mol_type = other RNA
cagtagttgtcggcgtcagtt

SEQ ID NO: 2914 - RNA, 21 nt, synthetic construct
  source 1..21: mol_type = other RNA
gcagtagttgtcggcgtcatt

SEQ ID NO: 2915 - RNA, 21 nt, synthetic construct
  source 1..21: mol_type = other RNA
ggcagtagttgtcggcgtctt

SEQ ID NO: 2916 - RNA, 21 nt, synthetic construct
  source 1..21: mol_type = other RNA
cggcagtagttgtcggcgttt

SEQ ID NO: 2917 - RNA, 21 nt, synthetic construct
  source 1..21: mol_type = other RNA
agtgtgggggtgggagtggtt

SEQ ID NO: 2918 - RNA, 21 nt, synthetic construct
  source 1..21: mol_type = other RNA
ccggcagtagttgtcggcgtt

SEQ ID NO: 2919 - RNA, 21 nt, synthetic construct
  source 1..21: mol_type = other RNA
gccggcagtagttgtcggctt

SEQ ID NO: 2920 - RNA, 21 nt, synthetic construct
  source 1..21: mol_type = other RNA
agccggcagtagttgtcggtt

SEQ ID NO: 2921 - RNA, 21 nt, synthetic construct
  source 1..21: mol_type = other RNA
cagccggcagtagttgtcgtt

SEQ ID NO: 2922 - RNA, 21 nt, synthetic construct
  source 1..21: mol_type = other RNA
ccagccggcagtagttgtctt

SEQ ID NO: 2923 - RNA, 21 nt, synthetic construct
  source 1..21: mol_type = other RNA
tccagccggcagtagttgttt

SEQ ID NO: 2924 - RNA, 21 nt, synthetic construct
  source 1..21: mol_type = other RNA
ctccagccggcagtagttgtt

SEQ ID NO: 2925 - RNA, 21 nt, synthetic construct
  source 1..21: mol_type = other RNA
cctccagccggcagtagtttt

SEQ ID NO: 2926 - RNA, 21 nt, synthetic construct
  source 1..21: mol_type = other RNA
tcctccagccggcagtagttt

SEQ ID NO: 2927 - RNA, 21 nt, synthetic construct
  source 1..21: mol_type = other RNA
gtcctccagccggcagtagtt

SEQ ID NO: 2928 - RNA, 21 nt, synthetic construct
  source 1..21: mol_type = other RNA
gagtgtgggggtgggagtgtt

SEQ ID NO: 2929 - RNA, 21 nt, synthetic construct
  source 1..21: mol_type = other RNA
cgtcctccagccggcagtatt

SEQ ID NO: 2930 - RNA, 21 nt, synthetic construct
  source 1..21: mol_type = other RNA
gcgtcctccagccggcagttt

SEQ ID NO: 2931 - RNA, 21 nt, synthetic construct
  source 1..21: mol_type = other RNA
cgcgtcctccagccggcagtt

SEQ ID NO: 2932 - RNA, 21 nt, synthetic construct
  source 1..21: mol_type = other RNA
gcgcgtcctccagccggcatt

SEQ ID NO: 2933 - RNA, 21 nt, synthetic construct
  source 1..21: mol_type = other RNA
tgcgcgtcctccagccggctt

SEQ ID NO: 2934 - RNA, 21 nt, synthetic construct
  source 1..21: mol_type = other RNA
gtgcgcgtcctccagccggtt

SEQ ID NO: 2935 - RNA, 21 nt, synthetic construct
  source 1..21: mol_type = other RNA
ggtgcgcgtcctccagccgtt

SEQ ID NO: 2936 - RNA, 21 nt, synthetic construct
  source 1..21: mol_type = other RNA
aggtgcgcgtcctccagcctt

SEQ ID NO: 2937 - RNA, 21 nt, synthetic construct
  source 1..21: mol_type = other RNA
caggtgcgcgtcctccagctt

SEQ ID NO: 2938 - RNA, 21 nt, synthetic construct
  source 1..21: mol_type = other RNA
ccaggtgcgcgtcctccagtt

SEQ ID NO: 2939 - RNA, 21 nt, synthetic construct
  source 1..21: mol_type = other RNA
ggagtgtgggggtgggagttt

SEQ ID NO: 2940 - RNA, 21 nt, synthetic construct
  source 1..21: mol_type = other RNA
accaggtgcgcgtcctccatt

SEQ ID NO: 2941 - RNA, 21 nt, synthetic construct
  source 1..21: mol_type = other RNA
caccaggtgcgcgtcctcctt

SEQ ID NO: 2942 - RNA, 21 nt, synthetic construct
  source 1..21: mol_type = other RNA
ccaccaggtgcgcgtcctctt

SEQ ID NO: 2943 - RNA, 21 nt, synthetic construct
  source 1..21: mol_type = other RNA
accaccaggtgcgcgtccttt

SEQ ID NO: 2944 - RNA, 21 nt, synthetic construct
  source 1..21: mol_type = other RNA
caccaccaggtgcgcgtcctt

SEQ ID NO: 2945 - RNA, 21 nt, synthetic construct
  source 1..21: mol_type = other RNA
ccaccaccaggtgcgcgtctt

SEQ ID NO: 2946 - RNA, 21 nt, synthetic construct
  source 1..21: mol_type = other RNA
accaccaccaggtgcgcgttt

SEQ ID NO: 2947 - RNA, 21 nt, synthetic construct
  source 1..21: mol_type = other RNA
gaccaccaccaggtgcgcgtt

SEQ ID NO: 2948 - RNA, 21 nt, synthetic construct
  source 1..21: mol_type = other RNA
tgaccaccaccaggtgcgctt

SEQ ID NO: 2949 - RNA, 21 nt, synthetic construct
  source 1..21: mol_type = other RNA
gtgaccaccaccaggtgcgtt

SEQ ID NO: 2950 - RNA, 21 nt, synthetic construct
  source 1..21: mol_type = other RNA
gggagtgtgggggtgggagtt

SEQ ID NO: 2951 - RNA, 21 nt, synthetic construct
  source 1..21: mol_type = other RNA
cgtgaccaccaccaggtgctt

SEQ ID NO: 2952 - RNA, 21 nt, synthetic construct
  source 1..21: mol_type = other RNA
acgtgaccaccaccaggtgtt

SEQ ID NO: 2953 - RNA, 21 nt, synthetic construct
  source 1..21: mol_type = other RNA
gacgtgaccaccaccaggttt

SEQ ID NO: 2954 - RNA, 21 nt, synthetic construct
  source 1..21: mol_type = other RNA
ggacgtgaccaccaccaggtt

SEQ ID NO: 2955 - RNA, 21 nt, synthetic construct
  source 1..21: mol_type = other RNA
aggacgtgaccaccaccagtt

SEQ ID NO: 2956 - RNA, 21 nt, synthetic construct
  source 1..21: mol_type = other RNA
caggacgtgaccaccaccatt

SEQ ID NO: 2957 - RNA, 21 nt, synthetic construct
  source 1..21: mol_type = other RNA
ccaggacgtgaccaccacctt

SEQ ID NO: 2958 - RNA, 21 nt, synthetic construct
  source 1..21: mol_type = other RNA
cccaggacgtgaccaccactt

SEQ ID NO: 2959 - RNA, 21 nt, synthetic construct
  source 1..21: mol_type = other RNA
tcccaggacgtgaccaccatt

SEQ ID NO: 2960 - RNA, 21 nt, synthetic construct
  source 1..21: mol_type = other RNA
ctcccaggacgtgaccacctt

SEQ ID NO: 2961 - RNA, 21 nt, synthetic construct
  source 1..21: mol_type = other RNA
ggggagtgtgggggtgggatt

SEQ ID NO: 2962 - RNA, 21 nt, synthetic construct
  source 1..21: mol_type = other RNA
cctcccaggacgtgaccactt

SEQ ID NO: 2963 - RNA, 21 nt, synthetic construct
  source 1..21: mol_type = other RNA
tcctcccaggacgtgaccatt

SEQ ID NO: 2964 - RNA, 21 nt, synthetic construct
  source 1..21: mol_type = other RNA
ctcctcccaggacgtgacctt

SEQ ID NO: 2965 - RNA, 21 nt, synthetic construct
  source 1..21: mol_type = other RNA
gctcctcccaggacgtgactt

SEQ ID NO: 2966 - RNA, 21 nt, synthetic construct
  source 1..21: mol_type = other RNA
tgctcctcccaggacgtgatt

SEQ ID NO: 2967 - RNA, 21 nt, synthetic construct
  source 1..21: mol_type = other RNA
ctgctcctcccaggacgtgtt

SEQ ID NO: 2968 - RNA, 21 nt, synthetic construct
  source 1..21: mol_type = other RNA
tctgctcctcccaggacgttt

SEQ ID NO: 2969 - RNA, 21 nt, synthetic construct
  source 1..21: mol_type = other RNA
ttctgctcctcccaggacgtt

SEQ ID NO: 2970 - RNA, 21 nt, synthetic construct
  source 1..21: mol_type = other RNA
tttctgctcctcccaggactt

SEQ ID NO: 2971 - RNA, 21 nt, synthetic construct
  source 1..21: mol_type = other RNA
atttctgctcctcccaggatt

SEQ ID NO: 2972 - RNA, 21 nt, synthetic construct
  source 1..21: mol_type = other RNA
aggggagtgtgggggtgggtt

SEQ ID NO: 2973 - RNA, 21 nt, synthetic construct
  source 1..21: mol_type = other RNA
aatttctgctcctcccaggtt

SEQ ID NO: 2974 - RNA, 21 nt, synthetic construct
  source 1..21: mol_type = other RNA
aaatttctgctcctcccagtt

SEQ ID NO: 2975 - RNA, 21 nt, synthetic construct
  source 1..21: mol_type = other RNA
caaatttctgctcctcccatt

SEQ ID NO: 2976 - RNA, 21 nt, synthetic construct
  source 1..21: mol_type = other RNA
acaaatttctgctcctccctt

SEQ ID NO: 2977 - RNA, 21 nt, synthetic construct
  source 1..21: mol_type = other RNA
gacaaatttctgctcctcctt

SEQ ID NO: 2978 - RNA, 21 nt, synthetic construct
  source 1..21: mol_type = other RNA
ggacaaatttctgctcctctt

SEQ ID NO: 2979 - RNA, 21 nt, synthetic construct
  source 1..21: mol_type = other RNA
tggacaaatttctgctccttt

SEQ ID NO: 2980 - RNA, 21 nt, synthetic construct
  source 1..21: mol_type = other RNA
ctggacaaatttctgctcctt

SEQ ID NO: 2981 - RNA, 21 nt, synthetic construct
  source 1..21: mol_type = other RNA
gctggacaaatttctgctctt

SEQ ID NO: 2982 - RNA, 21 nt, synthetic construct
  source 1..21: mol_type = other RNA
tgctggacaaatttctgcttt

SEQ ID NO: 2983 - RNA, 21 nt, synthetic construct
  source 1..21: mol_type = other RNA
gtgctggacaaatttctgctt

SEQ ID NO: 2984 - RNA, 21 nt, synthetic construct
  source 1..21: mol_type = other RNA
taggggagtgtgggggtggtt

SEQ ID NO: 2985 - RNA, 21 nt, synthetic construct
  source 1..21: mol_type = other RNA
ggtgctggacaaatttctgtt

SEQ ID NO: 2986 - RNA, 21 nt, synthetic construct
  source 1..21: mol_type = other RNA
tggtgctggacaaatttcttt

SEQ ID NO: 2987 - RNA, 21 nt, synthetic construct
  source 1..21: mol_type = other RNA
gtggtgctggacaaatttctt

SEQ ID NO: 2988 - RNA, 21 nt, synthetic construct
  source 1..21: mol_type = other RNA
tgtggtgctggacaaattttt

SEQ ID NO: 2989 - RNA, 21 nt, synthetic construct
  source 1..21: mol_type = other RNA
atgtggtgctggacaaatttt

SEQ ID NO: 2990 - RNA, 21 nt, synthetic construct
  source 1..21: mol_type = other RNA
tatgtggtgctggacaaattt

SEQ ID NO: 2991 - RNA, 21 nt, synthetic construct
  source 1..21: mol_type = other RNA
ctatgtggtgctggacaaatt

SEQ ID NO: 2992 - RNA, 21 nt, synthetic construct
  source 1..21: mol_type = other RNA
cctatgtggtgctggacaatt

SEQ ID NO: 2993 - RNA, 21 nt, synthetic construct
  source 1..21: mol_type = other RNA
tcttttctgagctgatggttt

SEQ ID NO: 2994 - RNA, 21 nt, synthetic construct
  source 1..21: mol_type = other RNA
gtcttttctgagctgatggtt

SEQ ID NO: 2995 - RNA, 21 nt, synthetic construct
  source 1..21: mol_type = other RNA
agtcttttctgagctgatgtt

SEQ ID NO: 2996 - RNA, 21 nt, synthetic construct
  source 1..21: mol_type = other RNA
gagtcttttctgagctgattt

SEQ ID NO: 2997 - RNA, 21 nt, synthetic construct
  source 1..21: mol_type = other RNA
ggagtcttttctgagctgatt

SEQ ID NO: 2998 - RNA, 21 nt, synthetic construct
  source 1..21: mol_type = other RNA
gggagtcttttctgagctgtt

SEQ ID NO: 2999 - RNA, 21 nt, synthetic construct
  source 1..21: mol_type = other RNA
tgggagtcttttctgagcttt

SEQ ID NO: 3000 - RNA, 21 nt, synthetic construct
  source 1..21: mol_type = other RNA
ctgggagtcttttctgagctt

SEQ ID NO: 3001 - RNA, 21 nt, synthetic construct
  source 1..21: mol_type = other RNA
gctgggagtcttttctgagtt

SEQ ID NO: 3002 - RNA, 21 nt, synthetic construct
  source 1..21: mol_type = other RNA
agctgggagtcttttctgatt

SEQ ID NO: 3003 - RNA, 21 nt, synthetic construct
  source 1..21: mol_type = other RNA
cagctgggagtcttttctgtt

SEQ ID NO: 3004 - RNA, 21 nt, synthetic construct
  source 1..21: mol_type = other RNA
gcagctgggagtcttttcttt

SEQ ID NO: 3005 - RNA, 21 nt, synthetic construct
  source 1..21: mol_type = other RNA
tgcagctgggagtcttttctt

SEQ ID NO: 3006 - RNA, 21 nt, synthetic construct
  source 1..21: mol_type = other RNA
ctgcagctgggagtctttttt

SEQ ID NO: 3007 - RNA, 21 nt, synthetic construct
  source 1..21: mol_type = other RNA
cctgcagctgggagtcttttt

SEQ ID NO: 3008 - RNA, 21 nt, synthetic construct
  source 1..21: mol_type = other RNA
tcctgcagctgggagtctttt

SEQ ID NO: 3009 - RNA, 21 nt, synthetic construct
  source 1..21: mol_type = other RNA
ctcctgcagctgggagtcttt

SEQ ID NO: 3010 - RNA, 21 nt, synthetic construct
  source 1..21: mol_type = other RNA
cctcctgcagctgggagtctt

SEQ ID NO: 3011 - DNA, 1245 bp, Mus musculus
  source 1..1245: mol_type = other DNA
cacatgggccctggatggaccctgtcccctcccctcccattgcccagggctcttcacctggttcttcaggcttcagccccctccttagcctgggctcttcgtggtgctgagggaccttcagtccggatccagtgccatcatgacaaaggattatcaagatttccagcacctggacaatgataatgaccatcatcaactccggagagggccgcctcccactccacggctcttgcagcgactctgctctggatcccgcctcctcctgctctcctcgagcctcagcattctgttgctggtggttgtctgtgtgatcacatcccaaaattcccaactccgggaagatctgctggctctaaggcagaatttcagcaacctcactgtgagcactgaggaccaggtcaaggccctgagcacccagggaagtagtgtgggaagaaagatgaagttagtggagtcgaagctggaaaaacagcagaaggatctgactgaagatcactccagtttgctactgcacgtgaagcagttagtgtctgacgtgcgaagcttgagctgccagatggctgcatttcggggcaatggctctgaaaggacctgctgccccatcaactgggtggagtatgaaggcagctgctactggttctccagctctgtgaggccttggactgaagctgacaagtactgccagctggaaaatgcccatctggtggtggtgacctccagggatgagcagaacttcctccagcgccacatgggccccttaaacacttggattggcctaactgaccagaacgggccctggaaatgggtggatggaacagactacgagacaggcttccagaattggagaccagagcagccagataactggtacggacatgggcttggaggaggcgaggactgtgcccacttcacgacggatggccgctggaatgacgacgtctgcaggaggccctaccgctgggtctgtgagacaaagttggataaggctaattaggaaccttccttcccctcatttatatccttaattccttgagctgctgaggtttagaactggtagagcctacctaagggtctccccatctccaggaactctcatgtaggatttttaaaggaccggtaaagaatggtgtttgagaaatggtgtatgatgcctggtggtggtaggggtgcgtattgaaacccagcgcgcagttctcttctgtcagcttgttttttttagagtaaaaggaagagaaataaaagttc

SEQ ID NO: 3012 - DNA, 1204 bp, Rattus norvegicus
  source 1..1204: mol_type = other DNA
ctgtccacctggttcttcaggcttcagccccctccttagcctgggctcttcgtggtgctgagggaccttcagtcctgccccagtgctatcatgacaaaggattatcaagatttccagcacttggacaatgagaacgaccaccatcaactccagagagggccacctcccgctccaaggctcttgcagcgactctgctctggattccgtctcttcctgctttccctgggcctcagcatcctgctgctggtggttgtctgtgtgatcacatcccaaaattcccaactccgggaagatctgcgggttctaaggcagaatttcagcaactttaccgtgagcactgaggaccaggtcaaggccctgaccacccagggagagagagtgggaagaaagatgaagttagtcgagtcacagctggaaaaacatcaggaggatctgagggaagaccactctagattgctactgcatgtaaagcagttagtgtctgacgtgcgaagcttgagctgccagatggccgcacttcggggcaatggctctgaaaggatctgctgccccatcaactgggtggagtatgaaggcagctgctactggttctccagctctgtgaagccttggacggaagctgacaagtactgccagctggagaacgcccacctggtggtggtgacttcctgggaggagcagagattcgtccagcaacacatgggccccttaaatacttggattggcctaactgaccagaacggaccctggaaatgggtggatgggacagactatgagacaggcttcaagaactggagaccagggcagccagatgactggtacggacatgggcttggagggggtgaagactgtgcccacttcaccaccgatggccactggaatgatgacgtctgcaggaggccctaccgctgggtctgtgagacagagttgggcaaggccaattaggagcctccattcccctgatttatttcctgagtgccttgagctgtgaggcttagagttgggaggtcctactcaagggtctccccatctttgggaactttcatctaggattttaaggggctggtaaagaatggtgtttgaggaatgtggtatgatgcctggtggtggtggtggtggtggttattggaacccatgacactttgtgcagtgtgcagcttactactgccaacttgtttttgagagtaaaagaaggaagataaac

SEQ ID NO: 3013 - DNA, 1417 bp, Macaca fascicularis
  source 1..1417: mol_type = other DNA
ttactgtccaaagtcccgggcactggagatgccacgtttggcgtgcttggacacacagacacgcagacacagagacaccggggcccagggccctcctatggaccctgcccgctcccactccatcgtccacggctgtccacccacccccattctccaagcttcagcccccctccttagtccggcatctgcacagcactgaagaacctgggagtcagaccctgagaccccgagcaactctagtcctcgtgagcccccacctcagccccagcctcagccttgactcagtcccagctccagcaccagccctatcatgaccaaggagtatcaggacctgcagcatctggacaatgaggagagtgaccaccatcagctcggaaaagggccacctcctccgcagtccctcctgcggcgtctctgctccggccctcgcctcctcctgctctccctgggcctcagcctcctgctgctggtggttgtctgtgtgatcggatcccaaaacgcccagctgcagcgggagctgcggggcctgagagagacgctcagcaacttcacagcgagcaccgaggcccaggtcaagggcttgagcacccagggaggcaatgtgggaagaaagatgaagtcgctggagtcccagctggagaaacagcagaaggacttgagtgaagatcactccagcctgctgctccacgtgaagcagttcgtgtctgacctgcggagcctgagctgtcagatggcggcgctccagggcaatggctcggaaagggcctgctgcccagtcaactgggtggagcacgagcgcagctgctactggttctctcgctccgggaaggcctgggccgacgccgacaactactgccggctggaggacgcgcacctggtggtggtcacgtcctgggaggagcagaaatttgtccagcaccacataggtcctgtgaacacctggatgggcctccacgaccaaaacgggccctggaagtgggtggacgggacggactacgagacgggcttcaagaactggagaccggagcagccggacgactggtacggccacgggctcgggggaggggaggactgtgcccacttcaccgacgacggccgctggaacgacgacgtctgccagaggccctaccgctgggtctgcgagacagagctggacaaggccagtcaggagccacctctcctttaatttatttcttcagtgcctcgacctgccgcaggggtccggggttgggaatccgcccgtctgggggcctcttctgctttctcggggattttcatgtaggattttaagggaaggggaaggataggatgatgttgggaaggtgggggacttgaaacccgtggcgctttctgtagtttgcacgttatcattgtcaacttttttttttttttagagtaaaaagaaatatacctaaac

SEQ ID NO: 3014 - RNA, 21 nt, synthetic construct
  source 1..21: mol_type = other RNA
  modified_base 4..7: mod_base = OTHER; note = 2'-O-methyl ribonucleotide
  modified_base 9..10: mod_base = OTHER; note = 2'-O-methyl ribonucleotide
  modified_base 12..13: mod_base = OTHER; note = 2'-O-methyl ribonucleotide
  modified_base 17..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
aggccctaccgctgggtcttt

SEQ ID NO: 3015 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3016 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3017 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3018 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3019 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3020 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3021 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3022 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3023 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aggccctaccgctgggtcttt

SEQ ID NO: 3024 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3025 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aggccctaccgctgggtcttt

SEQ ID NO: 3026 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3027 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3028 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3029 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3030 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3031 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3032 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3033 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3034 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3035 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3036 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3037 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3038 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3039 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3040 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
aggccctaccgctgggtcttt

SEQ ID NO: 3041 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
aggccctaccgctgggtcttt

SEQ ID NO: 3042 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
aggccctaccgctgggtcttt

SEQ ID NO: 3043 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
aggccctaccgctgggtcttt

SEQ ID NO: 3044 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
aggccctaccgctgggtcttt

SEQ ID NO: 3045 - RNA, 21 nt, synthetic construct
  source 1..21: mol_type = other RNA
  modified_base 2: mod_base = OTHER; note = 2'-O-methyl ribonucleotide
  modified_base 14: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gtgggaagaaagatgaagttt

SEQ ID NO: 3046 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3047 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3048 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3049 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3050 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3051 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3052 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3053 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3054 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 3055 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3056 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 3057 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3058 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3059 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3060 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3061 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3062 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3063 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3064 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3065 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3066 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3067 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3068 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3069 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3070 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3071 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gtgggaagaaagatgaagttt

SEQ ID NO: 3072 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 3073 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gtgggaagaaagatgaagttt

SEQ ID NO: 3074 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gtgggaagaaagatgaagttt

SEQ ID NO: 3075 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gtgggaagaaagatgaagttt

SEQ ID NO: 3076 - RNA, 21 nt, synthetic construct
  source 1..21: mol_type = other RNA
  modified_base 5: mod_base = OTHER; note = 2'-O-methyl ribonucleotide
  modified_base 9..12: mod_base = OTHER; note = 2'-O-methyl ribonucleotide
  modified_base 18..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gagacgggcttcaagaacttt

SEQ ID NO: 3077 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3078 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3079 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3080 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3081 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3082 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3083 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3084 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3085 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gagacgggcttcaagaacttt

SEQ ID NO: 3086 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3087 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gagacgggcttcaagaacttt

SEQ ID NO: 3088 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3089 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3090 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3091 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3092 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3093 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3094 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3095 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3096 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3097 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3098 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3099 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3100 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3101 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3102 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gagacgggcttcaagaacttt

SEQ ID NO: 3103 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 3104 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gagacgggcttcaagaacttt

SEQ ID NO: 3105 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gagacgggcttcaagaacttt

SEQ ID NO: 3106 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gagacgggcttcaagaacttt

SEQ ID NO: 3107 - RNA, 21 nt, synthetic construct
  source 1..21: mol_type = other RNA
  modified_base 4: mod_base = OTHER; note = 2'-O-methyl ribonucleotide
  modified_base 6: mod_base = OTHER; note = 2'-O-methyl ribonucleotide
  modified_base 9..10: mod_base = OTHER; note = 2'-O-methyl ribonucleotide
  modified_base 12..13: mod_base = OTHER; note = 2'-O-methyl ribonucleotide
  modified_base 15..16: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gagcgcagctgctactggttt

SEQ ID NO: 3108 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3109 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3110 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3111 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3112 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3113 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3114 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3115 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3116 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gagcgcagctgctactggttt

SEQ ID NO: 3117 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3118 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gagcgcagctgctactggttt

SEQ ID NO: 3119 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3120 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3121 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3122 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3123 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3124 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3125 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3126 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3127 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3128 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3129 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3130 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3131 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3132 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3133 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gagcgcagctgctactggttt

SEQ ID NO: 3134 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 3135 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gagcgcagctgctactggttt

SEQ ID NO: 3136 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gagcgcagctgctactggttt

SEQ ID NO: 3137 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gagcgcagctgctactggttt

SEQ ID NO: 3138 - RNA, 21 nt, synthetic construct
  source 1..21: mol_type = other RNA
  modified_base 2..3: mod_base = OTHER; note = 2'-O-methyl ribonucleotide
  modified_base 5..7: mod_base = OTHER; note = 2'-O-methyl ribonucleotide
  modified_base 9: mod_base = OTHER; note = 2'-O-methyl ribonucleotide
  modified_base 11: mod_base = OTHER; note = 2'-O-methyl ribonucleotide
  modified_base 14..15: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gttgtctgtgtgatcggattt

SEQ ID NO: 3139 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3140 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3141 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3142 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3143 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3144 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3145 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3146 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3147 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gttgtctgtgtgatcggattt

SEQ ID NO: 3148 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3149 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gttgtctgtgtgatcggattt

SEQ ID NO: 3150 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3151 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3152 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3153 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3154 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3155 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3156 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3157 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3158 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3159 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3160 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3161 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3162 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3163 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3164 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gttgtctgtgtgatcggattt

SEQ ID NO: 3165 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 3166 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gttgtctgtgtgatcggattt

SEQ ID NO: 3167 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gttgtctgtgtgatcggattt

SEQ ID NO: 3168 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gttgtctgtgtgatcggattt

SEQ ID NO: 3169 - RNA, 21 nt, synthetic construct
  source 1..21: mol_type = other RNA
  modified_base 5..6: mod_base = OTHER; note = 2'-O-methyl ribonucleotide
  modified_base 8: mod_base = OTHER; note = 2'-O-methyl ribonucleotide
  modified_base 13..15: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ggagctgcggggcctgagatt

SEQ ID NO: 3170 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3171 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3172 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3173 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3174 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3175 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3176 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3177 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3178 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggagctgcggggcctgagatt

SEQ ID NO: 3179 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3180 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggagctgcggggcctgagatt

SEQ ID NO: 3181 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3182 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3183 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3184 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3185 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3186 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3187 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3188 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3189 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3190 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3191 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3192 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3193 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3194 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3195 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ggagctgcggggcctgagatt

SEQ ID NO: 3196 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 3197 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
ggagctgcggggcctgagatt

SEQ ID NO: 3198 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ggagctgcggggcctgagatt

SEQ ID NO: 3199 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
ggagctgcggggcctgagatt

SEQ ID NO: 3200 - RNA, 21 nt, synthetic construct
  source 1..21: mol_type = other RNA
  modified_base 2..3: mod_base = OTHER; note = 2'-O-methyl ribonucleotide
  modified_base 5..6: mod_base = OTHER; note = 2'-O-methyl ribonucleotide
  modified_base 11: mod_base = OTHER; note = 2'-O-methyl ribonucleotide
  modified_base 14: mod_base = OTHER; note = 2'-O-methyl ribonucleotide
  modified_base 17: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gccgctggaacgacgacgttt

SEQ ID NO: 3201 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3202 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3203 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3204 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3205 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3206 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3207 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3208 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3209 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gccgctggaacgacgacgttt

SEQ ID NO: 3210 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3211 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gccgctggaacgacgacgttt

SEQ ID NO: 3212 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3213 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3214 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3215 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3216 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3217 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3218 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3219 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3220 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3221 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3222 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3223 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3224 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3225 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3226 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gccgctggaacgacgacgttt

SEQ ID NO: 3227 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 3228 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gccgctggaacgacgacgttt

SEQ ID NO: 3229 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gccgctggaacgacgacgttt

SEQ ID NO: 3230 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gccgctggaacgacgacgttt

SEQ ID NO: 3231 - RNA, 21 nt, synthetic construct
  source 1..21: mol_type = other RNA
  modified_base 2: mod_base = OTHER; note = 2'-O-methyl ribonucleotide
  modified_base 5..6: mod_base = OTHER; note = 2'-O-methyl ribonucleotide
  modified_base 8..9: mod_base = OTHER; note = 2'-O-methyl ribonucleotide
  modified_base 11..12: mod_base = OTHER; note = 2'-O-methyl ribonucleotide
  modified_base 15..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gcagctgctactggttctctt

SEQ ID NO: 3232 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3233 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3234 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3235 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3236 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3237 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3238 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3239 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3240 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 3241 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3242 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 3243 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3244 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3245 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3246 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3247 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3248 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3249 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3250 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3251 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3252 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3253 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3254 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3255 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3256 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3257 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gcagctgctactggttctctt

SEQ ID NO: 3258 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 3259 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gcagctgctactggttctctt

SEQ ID NO: 3260 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gcagctgctactggttctctt

SEQ ID NO: 3261 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gcagctgctactggttctctt

SEQ ID NO: 3262 - RNA, 21 nt, synthetic construct
  source 1..21: mol_type = other RNA
  modified_base 2..3: mod_base = OTHER; note = 2'-O-methyl ribonucleotide
  modified_base 7..9: mod_base = OTHER; note = 2'-O-methyl ribonucleotide
  modified_base 11: mod_base = OTHER; note = 2'-O-methyl ribonucleotide
  modified_base 16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gctgggtctgcgagacagatt

SEQ ID NO: 3263 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3264 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3265 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3266 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3267 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3268 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3269 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3270 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3271 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctgggtctgcgagacagatt

SEQ ID NO: 3272 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3273 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctgggtctgcgagacagatt

SEQ ID NO: 3274 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3275 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3276 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3277 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3278 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3279 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3280 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3281 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3282 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3283 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3284 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3285 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3286 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3287 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3288 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gctgggtctgcgagacagatt

SEQ ID NO: 3289 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 3290 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gctgggtctgcgagacagatt

SEQ ID NO: 3291 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gctgggtctgcgagacagatt

SEQ ID NO: 3292 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gctgggtctgcgagacagatt

SEQ ID NO: 3293 - RNA, 21 nt, synthetic construct
  source 1..21: mol_type = other RNA
  modified_base 2..8: mod_base = OTHER; note = 2'-O-methyl ribonucleotide
  modified_base 14..18: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gctttctcgggaattttcatt

SEQ ID NO: 3294 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3295 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3296 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3297 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3298 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3299 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3300 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3301 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3302 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctttctcgggaattttcatt

SEQ ID NO: 3303 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3304 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctttctcgggaattttcatt

SEQ ID NO: 3305 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3306 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3307 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3308 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3309 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3310 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3311 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3312 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3313 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3314 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3315 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3316 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3317 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3318 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3319 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gctttctcgggaattttcatt

SEQ ID NO: 3320 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 3321 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gctttctcgggaattttcatt

SEQ ID NO: 3322 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gctttctcgggaattttcatt

SEQ ID NO: 3323 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gctttctcgggaattttcatt

SEQ ID NO: 3324 - RNA, 21 nt, synthetic construct
  source 1..21: mol_type = other RNA
  modified_base 1..6: mod_base = OTHER; note = 2'-O-methyl ribonucleotide
  modified_base 8..9: mod_base = OTHER; note = 2'-O-methyl ribonucleotide
  modified_base 11..13: mod_base = OTHER; note = 2'-O-methyl ribonucleotide
  modified_base 15: mod_base = OTHER; note = 2'-O-methyl ribonucleotide
  modified_base 18..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
cctcctgctgcttgtggtttt

SEQ ID NO: 3325 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3326 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3327 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3328 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3329 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3330 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3331 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3332 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3333 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctcctgctgcttgtggtttt

SEQ ID NO: 3334 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3335 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctcctgctgcttgtggtttt

SEQ ID NO: 3336 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3337 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3338 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3339 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3340 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3341 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3342 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3343 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3344 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3345 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3346 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3347 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3348 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3349 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3350 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cctcctgctgcttgtggtttt

SEQ ID NO: 3351 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 3352 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
cctcctgctgcttgtggtttt

SEQ ID NO: 3353 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cctcctgctgcttgtggtttt

SEQ ID NO: 3354 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
cctcctgctgcttgtggtttt

SEQ ID NO: 3355 - RNA, 21 nt, synthetic construct
  source 1..21: mol_type = other RNA
  modified_base 1..2: mod_base = OTHER; note = 2'-O-methyl ribonucleotide
  modified_base 4..5: mod_base = OTHER; note = 2'-O-methyl ribonucleotide
  modified_base 7: mod_base = OTHER; note = 2'-O-methyl ribonucleotide
  modified_base 10..11: mod_base = OTHER; note = 2'-O-methyl ribonucleotide
  modified_base 18: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ctatcatgaccaaggagtatt

SEQ ID NO: 3356 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3357 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3358 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3359 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3360 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3361 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3362 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3363 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3364 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ctatcatgaccaaggagtatt

SEQ ID NO: 3365 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3366 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ctatcatgaccaaggagtatt

SEQ ID NO: 3367 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3368 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3369 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3370 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3371 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3372 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3373 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3374 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3375 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3376 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3377 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3378 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3379 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3380 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3381 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ctatcatgaccaaggagtatt

SEQ ID NO: 3382 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 3383 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
ctatcatgaccaaggagtatt

SEQ ID NO: 3384 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ctatcatgaccaaggagtatt

SEQ ID NO: 3385 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
ctatcatgaccaaggagtatt

SEQ ID NO: 3386 - RNA, 21 nt, synthetic construct
  source 1..21: mol_type = other RNA
  modified_base 1: mod_base = OTHER; note = 2'-O-methyl ribonucleotide
  modified_base 3..6: mod_base = OTHER; note = 2'-O-methyl ribonucleotide
  modified_base 15: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
cgtcctgggaggagcagaatt

SEQ ID NO: 3387 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3388 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3389 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3390 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3391 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3392 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3393 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3394 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3395 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cgtcctgggaggagcagaatt

SEQ ID NO: 3396 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3397 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cgtcctgggaggagcagaatt

SEQ ID NO: 3398 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3399 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3400 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3401 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3402 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3403 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3404 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3405 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3406 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3407 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3408 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3409 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3410 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3411 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3412 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cgtcctgggaggagcagaatt

SEQ ID NO: 3413 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 3414 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
cgtcctgggaggagcagaatt

SEQ ID NO: 3415 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cgtcctgggaggagcagaatt

SEQ ID NO: 3416 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
cgtcctgggaggagcagaatt

SEQ ID NO: 3417 - RNA, 21 nt, synthetic construct
  source 1..21: mol_type = other RNA
  modified_base 1..2: mod_base = OTHER; note = 2'-O-methyl ribonucleotide
  modified_base 8..15: mod_base = OTHER; note = 2'-O-methyl ribonucleotide
  modified_base 17..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ctgggggcctcttctgctttt

SEQ ID NO: 3418 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3419 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3420 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3421 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3422 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3423 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3424 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3425 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3426 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ctgggggcctcttctgctttt

SEQ ID NO: 3427 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3428 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ctgggggcctcttctgctttt

SEQ ID NO: 3429 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3430 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3431 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3432 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3433 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3434 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3435 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3436 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3437 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3438 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3439 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3440 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3441 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3442 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3443 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ctgggggcctcttctgctttt

SEQ ID NO: 3444 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 3445 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
ctgggggcctcttctgctttt

SEQ ID NO: 3446 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ctgggggcctcttctgctttt

SEQ ID NO: 3447 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
ctgggggcctcttctgctttt

SEQ ID NO: 3448 - RNA, 21 nt, synthetic construct
  source 1..21: mol_type = other RNA
  modified_base 1..3: mod_base = OTHER; note = 2'-O-methyl ribonucleotide
  modified_base 5..6: mod_base = OTHER; note = 2'-O-methyl ribonucleotide
  modified_base 8: mod_base = OTHER; note = 2'-O-methyl ribonucleotide
  modified_base 11..12: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
cctatcatgaccaaggagttt

SEQ ID NO: 3449 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3450 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3451 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3452 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3453 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3454 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3455 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3456 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3457 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctatcatgaccaaggagttt

SEQ ID NO: 3458 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3459 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctatcatgaccaaggagttt

SEQ ID NO: 3460 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3461 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3462 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3463 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3464 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3465 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3466 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3467 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3468 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3469 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3470 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3471 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3472 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3473 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3474 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cctatcatgaccaaggagttt

SEQ ID NO: 3475 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 3476 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
cctatcatgaccaaggagttt

SEQ ID NO: 3477 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cctatcatgaccaaggagttt

SEQ ID NO: 3478 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
cctatcatgaccaaggagttt

SEQ ID NO: 3479 - RNA, 21 nt, synthetic construct
  source 1..21: mol_type = other RNA
  modified_base 1: mod_base = OTHER; note = 2'-O-methyl ribonucleotide
  modified_base 3: mod_base = OTHER; note = 2'-O-methyl ribonucleotide
  modified_base 15: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tgtgggaagaaagatgaagtt

SEQ ID NO: 3480 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3481 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3482 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3483 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3484 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3485 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3486 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3487 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3488 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 3489 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3490 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 3491 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3492 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3493 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3494 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3495 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3496 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3497 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3498 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3499 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3500 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3501 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3502 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3503 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3504 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3505 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
tgtgggaagaaagatgaagtt

SEQ ID NO: 3506 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 3507 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
tgtgggaagaaagatgaagtt

SEQ ID NO: 3508 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
tgtgggaagaaagatgaagtt

SEQ ID NO: 3509 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
tgtgggaagaaagatgaagtt

SEQ ID NO: 3510 - RNA, 21 nt, synthetic construct
  source 1..21: mol_type = other RNA
  modified_base 5..6: mod_base = OTHER; note = 2'-O-methyl ribonucleotide
  modified_base 8: mod_base = OTHER; note = 2'-O-methyl ribonucleotide
  modified_base 10..12: mod_base = OTHER; note = 2'-O-methyl ribonucleotide
  modified_base 14..17: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
aggactgtgcccacttcactt

SEQ ID NO: 3511 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3512 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3513 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3514 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3515 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3516 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3517 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3518 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3519 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aggactgtgcccacttcactt

SEQ ID NO: 3520 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3521 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aggactgtgcccacttcactt

SEQ ID NO: 3522 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3523 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3524 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3525 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3526 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3527 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3528 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3529 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3530 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3531 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3532 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3533 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3534 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3535 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3536 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
aggactgtgcccacttcactt

SEQ ID NO: 3537 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 3538 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
aggactgtgcccacttcactt

SEQ ID NO: 3539 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
aggactgtgcccacttcactt

SEQ ID NO: 3540 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
aggactgtgcccacttcactt

SEQ ID NO: 3541 - RNA, 21 nt, synthetic construct
  source 1..21: mol_type = other RNA
  modified_base 3: mod_base = OTHER; note = 2'-O-methyl ribonucleotide
  modified_base 8: mod_base = OTHER; note = 2'-O-methyl ribonucleotide
  modified_base 11: mod_base = OTHER; note = 2'-O-methyl ribonucleotide
  modified_base 13..16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gatagggtgatgttccgaatt

SEQ ID NO: 3542 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3543 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3544 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3545 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3546 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3547 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3548 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3549 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3550 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gatagggtgatgttccgaatt

SEQ ID NO: 3551 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3552 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gatagggtgatgttccgaatt

SEQ ID NO: 3553 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3554 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3555 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3556 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3557 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3558 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3559 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3560 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3561 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3562 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3563 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3564 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3565 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3566 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3567 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gatagggtgatgttccgaatt

SEQ ID NO: 3568 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 3569 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gatagggtgatgttccgaatt

SEQ ID NO: 3570 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gatagggtgatgttccgaatt

SEQ ID NO: 3571 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gatagggtgatgttccgaatt

SEQ ID NO: 3572 - RNA, 21 nt, synthetic construct
  source 1..21: mol_type = other RNA
  modified_base 2: mod_base = OTHER; note = 2'-O-methyl ribonucleotide
  modified_base 5..7: mod_base = OTHER; note = 2'-O-methyl ribonucleotide
  modified_base 9: mod_base = OTHER; note = 2'-O-methyl ribonucleotide
  modified_base 13..14: mod_base = OTHER; note = 2'-O-methyl ribonucleotide
  modified_base 16..17: mod_base = OTHER; note = 2'-O-methyl ribonucleotide
  modified_base 19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gcagtttgcaggttatcattt

SEQ ID NO: 3573 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3574 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3575 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3576 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3577 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3578 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3579 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3580 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3581 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagtttgcaggttatcattt

SEQ ID NO: 3582 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3583 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagtttgcaggttatcattt

SEQ ID NO: 3584 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3585 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3586 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3587 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3588 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3589 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3590 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3591 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3592 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3593 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3594 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3595 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3596 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3597 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3598 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gcagtttgcaggttatcattt

SEQ ID NO: 3599 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 3600 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
gcagtttgcaggttatcattt

SEQ ID NO: 3601 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gcagtttgcaggttatcattt

SEQ ID NO: 3602 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
gcagtttgcaggttatcattt

SEQ ID NO: 3603 - RNA, 21 nt, synthetic construct
  source 1..21: mol_type = other RNA
  modified_base 3..4: mod_base = OTHER; note = 2'-O-methyl ribonucleotide
  modified_base 6..8: mod_base = OTHER; note = 2'-O-methyl ribonucleotide
  modified_base 10: mod_base = OTHER; note = 2'-O-methyl ribonucleotide
  modified_base 12: mod_base = OTHER; note = 2'-O-methyl ribonucleotide
  modified_base 15..16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ggttgtctgtgtgatcggatt

SEQ ID NO: 3604 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3605 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3606 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3607 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3608 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3609 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3610 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3611 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3612 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggttgtctgtgtgatcggatt

SEQ ID NO: 3613 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3614 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggttgtctgtgtgatcggatt

SEQ ID NO: 3615 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3616 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3617 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3618 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3619 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3620 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3621 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3622 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3623 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3624 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3625 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3626 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3627 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3628 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3629 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ggttgtctgtgtgatcggatt

SEQ ID NO: 3630 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
ggttgtctgtgtgatcggatt

SEQ ID NO: 3631 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
ggttgtctgtgtgatcggatt

SEQ ID NO: 3632 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
ggttgtctgtgtgatcggatt

SEQ ID NO: 3633 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
ggttgtctgtgtgatcggatt

SEQ ID NO: 3634 - RNA, 21 nt, synthetic construct
  source 1..21: mol_type = other RNA
  modified_base 1: mod_base = OTHER; note = 2'-O-methyl ribonucleotide
  modified_base 5..6: mod_base = OTHER; note = 2'-O-methyl ribonucleotide
  modified_base 8: mod_base = OTHER; note = 2'-O-methyl ribonucleotide
  modified_base 13: mod_base = OTHER; note = 2'-O-methyl ribonucleotide
  modified_base 17..19: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
cggactacgagacgggctttt

SEQ ID NO: 3635 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3636 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3637 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3638 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3639 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3640 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3641 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3642 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3643 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cggactacgagacgggctttt

SEQ ID NO: 3644 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3645 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cggactacgagacgggctttt

SEQ ID NO: 3646 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3647 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3648 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3649 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3650 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3651 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3652 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3653 - RNA, 21 nt, synthetic construct
  source 1..21: mol_type = other RNA
  modified_base 1..2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3654 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3655 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3656 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3657 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3658 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3659 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3660 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cggactacgagacgggctttt

SEQ ID NO: 3661 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
cggactacgagacgggctttt

SEQ ID NO: 3662 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
cggactacgagacgggctttt

SEQ ID NO: 3663 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
cggactacgagacgggctttt

SEQ ID NO: 3664 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
cggactacgagacgggctttt

SEQ ID NO: 3665 - RNA, 21 nt, synthetic construct
  source 1..21: mol_type = other RNA
  modified_base 6: mod_base = OTHER; note = 2'-O-methyl ribonucleotide
  modified_base 12: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
agacccagcggtagggccttt

SEQ ID NO: 3666 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3667 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3668 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3669 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3670 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3671 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3672 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3673 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3674 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3675 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
agacccagcggtagggccttt

SEQ ID NO: 3676 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3677 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
agacccagcggtagggccttt

SEQ ID NO: 3678 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3679 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3680 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3681 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3682 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3683 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3684 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3685 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3686 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3687 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3688 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3689 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3690 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3691 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3692 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3693 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3694 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3695 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agacccagcggtagggccttt

SEQ ID NO: 3696 - RNA, 21 nt, synthetic construct
  source 1..21: mol_type = other RNA
  modified_base 5: mod_base = OTHER; note = 2'-O-methyl ribonucleotide
  modified_base 17: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
acttcatctttcttcccactt

SEQ ID NO: 3697 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3698 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3699 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3700 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3701 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3702 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3703 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3704 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3705 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3706 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 3707 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3708 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 3709 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3710 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3711 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3712 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3713 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3714 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3715 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3716 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3717 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3718 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3719 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3720 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3721 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3722 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3723 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3724 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3725 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3726 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 3727 - RNA, 21 nt, synthetic construct
  source 1..21: mol_type = other RNA
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
agttcttgaagcccgtctctt

SEQ ID NO: 3728 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3729 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3730 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3731 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3732 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3733 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3734 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3735 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3736 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3737 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
agttcttgaagcccgtctctt

SEQ ID NO: 3738 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3739 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
agttcttgaagcccgtctctt

SEQ ID NO: 3740 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3741 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3742 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3743 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3744 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3745 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3746 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3747 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3748 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3749 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3750 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3751 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3752 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3753 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3754 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3755 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3756 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3757 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
agttcttgaagcccgtctctt

SEQ ID NO: 3758 - RNA, 21 nt, synthetic construct
  source 1..21: mol_type = other RNA
  modified_base 3: mod_base = OTHER; note = 2'-O-methyl ribonucleotide
  modified_base 6: mod_base = OTHER; note = 2'-O-methyl ribonucleotide
  modified_base 9: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
accagtagcagctgcgctctt

SEQ ID NO: 3759 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3760 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3761 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3762 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3763 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3764 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3765 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3766 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3767 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3768 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
accagtagcagctgcgctctt

SEQ ID NO: 3769 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3770 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
accagtagcagctgcgctctt

SEQ ID NO: 3771 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3772 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3773 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3774 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3775 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3776 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3777 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3778 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3779 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3780 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3781 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3782 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3783 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3784 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3785 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3786 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3787 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3788 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
accagtagcagctgcgctctt

SEQ ID NO: 3789 - RNA, 21 nt, synthetic construct
  source 1..21: mol_type = other RNA
  modified_base 8: mod_base = OTHER; note = 2'-O-methyl ribonucleotide
  modified_base 10: mod_base = OTHER; note = 2'-O-methyl ribonucleotide
  modified_base 12: mod_base = OTHER; note = 2'-O-methyl ribonucleotide
  modified_base 16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
atccgatcacacagacaactt

SEQ ID NO: 3790 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3791 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3792 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3793 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3794 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3795 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3796 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3797 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3798 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3799 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atccgatcacacagacaactt

SEQ ID NO: 3800 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3801 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atccgatcacacagacaactt

SEQ ID NO: 3802 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3803 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3804 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3805 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3806 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3807 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3808 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3809 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3810 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3811 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3812 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3813 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3814 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3815 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3816 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3817 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3818 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3819 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 3820 - RNA, 21 nt, synthetic construct
  source 1..21: mol_type = other RNA
  modified_base 4: mod_base = OTHER; note = 2'-O-methyl ribonucleotide
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tctcaggccccgcagctcctt

SEQ ID NO: 3821 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3822 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3823 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3824 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3825 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3826 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3827 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3828 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3829 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3830 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctcaggccccgcagctcctt

SEQ ID NO: 3831 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3832 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctcaggccccgcagctcctt

SEQ ID NO: 3833 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3834 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3835 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3836 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3837 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3838 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3839 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3840 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3841 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3842 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3843 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3844 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3845 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3846 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3847 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3848 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3849 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3850 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctcaggccccgcagctcctt

SEQ ID NO: 3851 - RNA, 21 nt, synthetic construct
  source 1..21: mol_type = other RNA
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
acgtcgtcgttccagcggctt

SEQ ID NO: 3852 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3853 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3854 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3855 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3856 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3857 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3858 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3859 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3860 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3861 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acgtcgtcgttccagcggctt

SEQ ID NO: 3862 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3863 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acgtcgtcgttccagcggctt

SEQ ID NO: 3864 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3865 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3866 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3867 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3868 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3869 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3870 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3871 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3872 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3873 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3874 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3875 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3876 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3877 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3878 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3879 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3880 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3881 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 3882 - RNA, 21 nt, synthetic construct
  source 1..21: mol_type = other RNA
  modified_base 7: mod_base = OTHER; note = 2'-O-methyl ribonucleotide
  modified_base 10: mod_base = OTHER; note = 2'-O-methyl ribonucleotide
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gagaaccagtagcagctgctt

SEQ ID NO: 3883 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3884 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3885 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3886 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3887 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3888 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3889 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3890 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3891 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3892 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gagaaccagtagcagctgctt

SEQ ID NO: 3893 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3894 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gagaaccagtagcagctgctt

SEQ ID NO: 3895 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3896 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3897 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3898 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3899 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3900 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3901 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3902 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3903 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3904 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3905 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3906 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3907 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3908 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3909 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3910 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3911 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3912 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 3913 - RNA, 21 nt, synthetic construct
  source 1..21: mol_type = other RNA
  modified_base 10: mod_base = OTHER; note = 2'-O-methyl ribonucleotide
  modified_base 16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tctgtctcgcagacccagctt

SEQ ID NO: 3914 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3915 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3916 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3917 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3918 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3919 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3920 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3921 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3922 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3923 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctgtctcgcagacccagctt

SEQ ID NO: 3924 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3925 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctgtctcgcagacccagctt

SEQ ID NO: 3926 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3927 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3928 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3929 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3930 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3931 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3932 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3933 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3934 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3935 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3936 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3937 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3938 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3939 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3940 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3941 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3942 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3943 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tctgtctcgcagacccagctt

SEQ ID NO: 3944 - RNA, 21 nt, synthetic construct
  source 1..21: mol_type = other RNA
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tgaaaattcccgagaaagctt

SEQ ID NO: 3945 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3946 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3947 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3948 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3949 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3950 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3951 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3952 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3953 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3954 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tgaaaattcccgagaaagctt

SEQ ID NO: 3955 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3956 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tgaaaattcccgagaaagctt

SEQ ID NO: 3957 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3958 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3959 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3960 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3961 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3962 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3963 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3964 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3965 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3966 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3967 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3968 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3969 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3970 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3971 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3972 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3973 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3974 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tgaaaattcccgagaaagctt

SEQ ID NO: 3975 - RNA, 21 nt, synthetic construct
  source 1..21: mol_type = other RNA
  modified_base 4: mod_base = OTHER; note = 2'-O-methyl ribonucleotide
  modified_base 6: mod_base = OTHER; note = 2'-O-methyl ribonucleotide
  modified_base 10: mod_base = OTHER; note = 2'-O-methyl ribonucleotide
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
aaccacaagcagcaggaggtt

SEQ ID NO: 3976 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3977 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3978 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3979 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3980 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3981 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3982 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3983 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3984 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3985 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aaccacaagcagcaggaggtt

SEQ ID NO: 3986 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3987 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aaccacaagcagcaggaggtt

SEQ ID NO: 3988 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3989 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3990 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3991 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3992 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3993 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3994 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3995 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3996 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3997 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3998 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 3999 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4000 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4001 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4002 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4003 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4004 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4005 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aaccacaagcagcaggaggtt

SEQ ID NO: 4006 - RNA, 21 nt, synthetic construct
  source 1..21: mol_type = other RNA
  modified_base 1: mod_base = OTHER; note = 2'-O-methyl ribonucleotide
  modified_base 12: mod_base = OTHER; note = 2'-O-methyl ribonucleotide
  modified_base 17: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tactccttggtcatgatagtt

SEQ ID NO: 4007 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4008 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4009 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4010 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4011 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4012 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4013 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4014 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4015 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4016 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tactccttggtcatgatagtt

SEQ ID NO: 4017 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4018 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tactccttggtcatgatagtt

SEQ ID NO: 4019 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4020 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4021 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4022 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4023 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4024 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4025 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4026 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4027 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4028 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4029 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4030 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4031 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4032 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4033 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4034 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4035 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4036 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4037 - RNA, 21 nt, synthetic construct
  source 1..21: mol_type = other RNA
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ttctgctcctcccaggacgtt

SEQ ID NO: 4038 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4039 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4040 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4041 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4042 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4043 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4044 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4045 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4046 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4047 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttctgctcctcccaggacgtt

SEQ ID NO: 4048 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4049 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttctgctcctcccaggacgtt

SEQ ID NO: 4050 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4051 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4052 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4053 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4054 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4055 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4056 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4057 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4058 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4059 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4060 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4061 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4062 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4063 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4064 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4065 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4066 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4067 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttctgctcctcccaggacgtt

SEQ ID NO: 4068 - RNA, 21 nt, synthetic construct
  source 1..21: mol_type = other RNA
  modified_base 4: mod_base = OTHER; note = 2'-O-methyl ribonucleotide
  modified_base 17: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
aagcagaagaggcccccagtt

SEQ ID NO: 4069 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4070 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4071 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4072 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4073 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4074 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4075 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4076 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4077 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4078 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aagcagaagaggcccccagtt

SEQ ID NO: 4079 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4080 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aagcagaagaggcccccagtt

SEQ ID NO: 4081 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4082 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4083 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4084 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4085 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4086 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4087 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4088 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4089 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4090 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4091 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4092 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4093 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4094 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4095 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4096 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4097 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4098 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcagaagaggcccccagtt

SEQ ID NO: 4099 - RNA, 21 nt, synthetic construct
  source 1..21: mol_type = other RNA
  modified_base 11: mod_base = OTHER; note = 2'-O-methyl ribonucleotide
  modified_base 16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
actccttggtcatgataggtt

SEQ ID NO: 4100 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4101 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4102 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4103 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4104 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4105 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4106 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4107 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4108 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4109 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
actccttggtcatgataggtt

SEQ ID NO: 4110 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4111 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
actccttggtcatgataggtt

SEQ ID NO: 4112 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4113 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4114 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4115 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4116 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4117 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4118 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4119 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4120 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4121 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4122 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4123 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4124 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4125 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4126 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4127 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4128 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4129 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4130 - RNA, 21 nt, synthetic construct
  source 1..21: mol_type = other RNA
  modified_base 4: mod_base = OTHER; note = 2'-O-methyl ribonucleotide
  modified_base 16: mod_base = OTHER; note = 2'-O-methyl ribonucleotide
  modified_base 18: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
cttcatctttcttcccacatt

SEQ ID NO: 4131 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4132 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4133 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4134 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4135 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4136 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4137 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4138 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4139 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4140 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
cttcatctttcttcccacatt

SEQ ID NO: 4141 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4142 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
cttcatctttcttcccacatt

SEQ ID NO: 4143 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4144 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4145 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4146 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4147 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4148 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4149 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4150 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4151 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4152 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4153 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4154 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4155 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4156 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4157 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4158 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4159 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4160 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4161 - RNA, 21 nt, synthetic construct
  source 1..21: mol_type = other RNA
  modified_base 11: mod_base = OTHER; note = 2'-O-methyl ribonucleotide
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
gtgaagtgggcacagtccttt

SEQ ID NO: 4162 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4163 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4164 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4165 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4166 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4167 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4168 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4169 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4170 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4171 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gtgaagtgggcacagtccttt

SEQ ID NO: 4172 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4173 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gtgaagtgggcacagtccttt

SEQ ID NO: 4174 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4175 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4176 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4177 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4178 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4179 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4180 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4181 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4182 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4183 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4184 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4185 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4186 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4187 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4188 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4189 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4190 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4191 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgaagtgggcacagtccttt

SEQ ID NO: 4192 - RNA, 21 nt, synthetic construct
  source 1..21: mol_type = other RNA
  modified_base 8: mod_base = OTHER; note = 2'-O-methyl ribonucleotide
  modified_base 11: mod_base = OTHER; note = 2'-O-methyl ribonucleotide
  modified_base 16: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
ttcggaacatcaccctatctt

SEQ ID NO: 4193 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4194 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4195 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4196 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4197 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4198 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4199 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4200 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4201 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4202 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttcggaacatcaccctatctt

SEQ ID NO: 4203 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4204 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttcggaacatcaccctatctt

SEQ ID NO: 4205 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4206 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4207 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4208 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4209 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4210 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4211 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4212 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4213 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4214 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4215 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4216 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4217 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4218 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4219 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4220 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4221 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4222 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4223 - RNA, 21 nt, synthetic construct
  source 1..21: mol_type = other RNA
  modified_base 5: mod_base = OTHER; note = 2'-O-methyl ribonucleotide
  modified_base 12: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
atgataacctgcaaactgctt

SEQ ID NO: 4224 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4225 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4226 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4227 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4228 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4229 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4230 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4231 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4232 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4233 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atgataacctgcaaactgctt

SEQ ID NO: 4234 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4235 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atgataacctgcaaactgctt

SEQ ID NO: 4236 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4237 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4238 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4239 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4240 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4241 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4242 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4243 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4244 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4245 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4246 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4247 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4248 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4249 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4250 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4251 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4252 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4253 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
atgataacctgcaaactgctt

SEQ ID NO: 4254 - RNA, 21 nt, synthetic construct
  source 1..21: mol_type = other RNA
  modified_base 7: mod_base = OTHER; note = 2'-O-methyl ribonucleotide
  modified_base 9: mod_base = OTHER; note = 2'-O-methyl ribonucleotide
  modified_base 11: mod_base = OTHER; note = 2'-O-methyl ribonucleotide
  modified_base 15: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
tccgatcacacagacaacctt

SEQ ID NO: 4255 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4256 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4257 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4258 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4259 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4260 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4261 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4262 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4263 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4264 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tccgatcacacagacaacctt

SEQ ID NO: 4265 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4266 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tccgatcacacagacaacctt

SEQ ID NO: 4267 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4268 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4269 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4270 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4271 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4272 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4273 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4274 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4275 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4276 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4277 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4278 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4279 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4280 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4281 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4282 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4283 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4284 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
tccgatcacacagacaacctt

SEQ ID NO: 4285 - RNA, 21 nt, synthetic construct
  source 1..21: mol_type = other RNA
  modified_base 13: mod_base = OTHER; note = 2'-O-methyl ribonucleotide
  modified_base 20..21: mod_base = OTHER; note = 2'-deoxy nucleotide
  modified_base 20..21: mod_base = OTHER; note = phosphorothioate internucleotide linkage
  modified_base 20..21: mod_base = OTHER; note = Thymine
aagcccgtctcgtagtccgtt

SEQ ID NO: 4286 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4287 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4288 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4289 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4290 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4291 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4292 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4293 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4294 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4295 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aagcccgtctcgtagtccgtt

SEQ ID NO: 4296 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4297 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aagcccgtctcgtagtccgtt

SEQ ID NO: 4298 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4299 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4300 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4301 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4302 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4303 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4304 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4305 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4306 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4307 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4308 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4309 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4310 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4311 - RNA, 21 nt, synthetic construct
  source 1..21: mol_type = other RNA
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4312 - RNA, 21 nt, synthetic construct
  source 1..21: mol_type = other RNA
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10..11: mod_base = OTHER; note = 2'-O-methyl ribonucleotide
  modified_base 12..13: mod_base = OTHER; note = 2'-deoxy-2'-fluoro ribonucleotide
  modified_base 14..15: mod_base = OTHER; note = 2'-O-methyl ribonucleotide
  modified_base 16..17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4313 - RNA, 21 nt, synthetic construct
  source 1..21: mol_type = other RNA
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10..11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16..17: mod_base = OTHER; note = 2'-O-methyl ribonucleotide
  modified_base 18..19: mod_base = OTHER; note = 2'-deoxy-2'-fluoro ribonucleotide
  modified_base 20..21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4314 - RNA, 21 nt, synthetic construct
  source 1..21: mol_type = other RNA
  modified_base 1..2: mod_base = OTHER; note = 2'-deoxy-2'-fluoro ribonucleotide
  modified_base 3..4: mod_base = OTHER; note = 2'-O-methyl ribonucleotide
  modified_base 5..6: mod_base = OTHER; note = 2'-deoxy-2'-fluoro ribonucleotide
  modified_base 7..8: mod_base = OTHER; note = 2'-O-methyl ribonucleotide
  modified_base 9..10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4315 - RNA, 21 nt, synthetic construct
  source 1..21: mol_type = other RNA
  modified_base 1..2: mod_base = OTHER; note = 2'-O-methyl ribonucleotide
  modified_base 3..4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9..10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19..20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
aagcccgtctcgtagtccgtt

SEQ ID NO: 4316 - RNA, 19 nt, Homo sapiens
  source 1..19: mol_type = other RNA
ttacatcgttaatgcgtta

SEQ ID NO: 4317 - RNA, 19 nt, Homo sapiens
  source 1..19: mol_type = other RNA
acttcacagcgagcacgga

SEQ ID NO: 4318 - RNA, 19 nt, Homo sapiens
  source 1..19: mol_type = other RNA
gcatcttggtgaaacgtga

SEQ ID NO: 4319 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..10: mod_base = OTHER; note = 2'-deoxy-2'-fluoro ribonucleotide
  modified_base 11: mod_base = OTHER; note = 2'-deoxy nucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4320 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-deoxy nucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4321 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy nucleotide
  modified_base 10..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4322 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-deoxy nucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4323 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy nucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4324 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-deoxy nucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4325 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-deoxy nucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4326 - RNA, 21 nt, synthetic construct
  source 1..21: mol_type = other RNA
  modified_base 1: mod_base = OTHER; note = 5'-monophosphate
  modified_base 1..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy nucleotide
  modified_base 12..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4327 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4328 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4329 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4330 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4331 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4332 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4333 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..10: mod_base = OTHER; note = 2'-deoxy-2'-fluoro ribonucleotide
  modified_base 11: mod_base = OTHER; note = 2'-deoxy nucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4334 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-deoxy nucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 9: mod_base = OTHER; note = Thymine
gcagctgctactggttctctt

SEQ ID NO: 4335 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy nucleotide
  modified_base 10..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 9: mod_base = OTHER; note = Thymine
gcagctgctactggttctctt

SEQ ID NO: 4336 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..10: mod_base = OTHER; note = 2'-deoxy-2'-fluoro ribonucleotide
  modified_base 11: mod_base = OTHER; note = 2'-deoxy nucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4337 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy nucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4338 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-deoxy nucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4339 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-deoxy nucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 9: mod_base = OTHER; note = Thymine
gcagctgctactggttctctt

SEQ ID NO: 4340 - RNA, 21 nt, synthetic construct
  source 1..21: mol_type = other RNA
  modified_base 1: mod_base = OTHER; note = 5'-monophosphate
  modified_base 1..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy nucleotide
  modified_base 12..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4341 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..18: mod_base = OTHER; note = 2'-O-methyl ribonucleotide
  modified_base 19: mod_base = OTHER; note = 2'-deoxy-2'-fluoro ribonucleotide
  modified_base 20..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4342 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 4343 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 4344 - RNA, 21 nt, synthetic construct
  source 1..21: mol_type = other RNA
  modified_base 1: mod_base = OTHER; note = 5'-monophosphate
  modified_base 1..6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy nucleotide
  modified_base 12..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 4345 - RNA, 21 nt, synthetic construct
  source 1..21: mol_type = other RNA
  modified_base 1: mod_base = OTHER; note = 5'-monophosphate
  modified_base 1..4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14..18: mod_base = OTHER; note = 2'-O-methyl ribonucleotide
  modified_base 19: mod_base = OTHER; note = 2'-deoxy-2'-fluoro ribonucleotide
  modified_base 20..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 4346 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 4347 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 4348 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgtgggaagaaagatgaagtt

SEQ ID NO: 4349 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
aggactgtgcccacttcactt

SEQ ID NO: 4350 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagacgggcttcaagaacttt

SEQ ID NO: 4351 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gagcgcagctgctactggttt

SEQ ID NO: 4352 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gttgtctgtgtgatcggattt

SEQ ID NO: 4353 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ggagctgcggggcctgagatt

SEQ ID NO: 4354 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gccgctggaacgacgacgttt

SEQ ID NO: 4355 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgggtctgcgagacagatt

SEQ ID NO: 4356 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctttctcgggaattttcatt

SEQ ID NO: 4357 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctgcttgtggtttt

SEQ ID NO: 4358 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctatcatgaccaaggagtatt

SEQ ID NO: 4359 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cgtcctgggaggagcagaatt

SEQ ID NO: 4360 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
ctgggggcctcttctgctttt

SEQ ID NO: 4361 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctatcatgaccaaggagttt

SEQ ID NO: 4362 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gatagggtgatgttccgaatt

SEQ ID NO: 4363 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagtttgcaggttatcattt

SEQ ID NO: 4364 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagtcg

SEQ ID NO: 4365 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctc

SEQ ID NO: 4366 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtc

SEQ ID NO: 4367 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
atgtgggaagaaagatgaagt

SEQ ID NO: 4368 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcgcagctgctactggttctc

SEQ ID NO: 4369 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aatgtgggaagaaagatgaag

SEQ ID NO: 4370 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gacgggacggactacgagatt

SEQ ID NO: 4371 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
agccacctctcctttaatttt

SEQ ID NO: 4372 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgacctgcggagcctgagctt

SEQ ID NO: 4373 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctgctctccctgggcctctt

SEQ ID NO: 4374 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctcctgctctccctgggctt

SEQ ID NO: 4375 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctgctactggttctctcgtt

SEQ ID NO: 4376 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cccattctccaagcttcagtt

SEQ ID NO: 4377 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
actggttctctcgctccggtt

SEQ ID NO: 4378 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gacgggacggactacgagatt

SEQ ID NO: 4379 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
agccacctctcctttaatttt

SEQ ID NO: 4380 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcacgagcgcagctgctactt

SEQ ID NO: 4381 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcgcagctgctactggttctt

SEQ ID NO: 4382 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
acgggacggactacgagactt

SEQ ID NO: 4383 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctccacgtgaagcagttctt

SEQ ID NO: 4384 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgacctgcggagcctgagctt

SEQ ID NO: 4385 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctgcggggcctgagagagtt

SEQ ID NO: 4386 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ttcaccgacgacggccgcttt

SEQ ID NO: 4387 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ccacgaccaaaacgggccctt

SEQ ID NO: 4388 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctgctctccctgggcctctt

SEQ ID NO: 4389 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cctcctgctctccctgggctt

SEQ ID NO: 4390 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gggaagaaagatgaagtcgtt

SEQ ID NO: 4391 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ccacttcaccgacgacggctt

SEQ ID NO: 4392 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gctgctactggttctctcgtt

SEQ ID NO: 4393 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aacgggccctggaagtgggtt

SEQ ID NO: 4394 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
agcagccggacgactggtatt

SEQ ID NO: 4395 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ctgcgagacagagctggactt

SEQ ID NO: 4396 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggaggacgcgcacctggtgtt

SEQ ID NO: 4397 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tcacgtcctgggaggagcatt

SEQ ID NO: 4398 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
aaggacctgctgcccggtctt

SEQ ID NO: 4399 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cccattctccaagcttcagtt

SEQ ID NO: 4400 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
atgggcctccacgaccaaatt

SEQ ID NO: 4401 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cgacggccgctggaacgactt

SEQ ID NO: 4402 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
actggttctctcgctccggtt

SEQ ID NO: 4403 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
cgaccaaaacgggccctggtt

SEQ ID NO: 4404 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
ggtctgcgagacagagctgtt

SEQ ID NO: 4405 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gacgggacggactacgagatt

SEQ ID NO: 4406 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
agccacctctcctttaatttt

SEQ ID NO: 4407 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
tgacctgcggagcctgagctt

SEQ ID NO: 4408 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctgctctccctgggcctctt

SEQ ID NO: 4409 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cctcctgctctccctgggctt

SEQ ID NO: 4410 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gctgctactggttctctcgtt

SEQ ID NO: 4411 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
cccattctccaagcttcagtt

SEQ ID NO: 4412 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
actggttctctcgctccggtt

SEQ ID NO: 4413 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcagctgctactggttctctt

SEQ ID NO: 4414 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4415 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4416 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4417 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 4418 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4419 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4420 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4421 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 4422 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18..19: mod_base = OTHER; note = 2'-O-methyl ribonucleotide
  modified_base 20..21: mod_base = OTHER; note = 2'-deoxy-2'-fluoro ribonucleotide
gtgggaagaaagatgaagttt

SEQ ID NO: 4423 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 4424 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4425 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gtgggaagaaagatgaagttt

SEQ ID NO: 4426 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4427 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
tgtgggaagaaagatgaagtt

SEQ ID NO: 4428 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4429 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4430 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4431 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4432 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4..5: mod_base = OTHER; note = 2'-O-methyl ribonucleotide
  modified_base 6..7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4433 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4..5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4434 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4435 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13..14: mod_base = OTHER; note = 2'-deoxy-2'-fluoro ribonucleotide
  modified_base 15..16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4436 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15..16: mod_base = OTHER; note = 2'-deoxy-2'-fluoro ribonucleotide
  modified_base 17..18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4437 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17..18: mod_base = OTHER; note = 2'-deoxy-2'-fluoro ribonucleotide
  modified_base 19..20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4438 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4439 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4440 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4441 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcagctgctactggttctctt

SEQ ID NO: 4442 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12..13: mod_base = OTHER; note = 2'-O-methyl ribonucleotide
  modified_base 14..15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4443 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gccgctggaacgacgacgttt

SEQ ID NO: 4444 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gatagggtgatgttccgaatt

SEQ ID NO: 4445 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cctatcatgaccaaggagttt

SEQ ID NO: 4446 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ctatcatgaccaaggagtatt

SEQ ID NO: 4447 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aacgggccctggaagtgggtt

SEQ ID NO: 4448 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gacgggacggactacgagatt

SEQ ID NO: 4449 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acgggacggactacgagactt

SEQ ID NO: 4450 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agcagccggacgactggtatt

SEQ ID NO: 4451 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ccacttcaccgacgacggctt

SEQ ID NO: 4452 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cgacggccgctggaacgactt

SEQ ID NO: 4453 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aaacccgtggcgctttctgtt

SEQ ID NO: 4454 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cctcttctgctttctcgggtt

SEQ ID NO: 4455 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gaaacccgtggcgctttcttt

SEQ ID NO: 4456 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcagaaatttgtccagcactt

SEQ ID NO: 4457 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ggactacgagacgggcttctt

SEQ ID NO: 4458 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgcccacttcaccgacgatt

SEQ ID NO: 4459 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gttgtctgtgtgatcggattt

SEQ ID NO: 4460 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ggtctgcgagacagagctgtt

SEQ ID NO: 4461 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agccacctctcctttaatttt

SEQ ID NO: 4462 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gctccacgtgaagcagttctt

SEQ ID NO: 4463 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcgcagctgctactggttctt

SEQ ID NO: 4464 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gctgctactggttctctcgtt

SEQ ID NO: 4465 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
actggttctctcgctccggtt

SEQ ID NO: 4466 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gcagctgctactggttctctt

SEQ ID NO: 4467 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gcagctgctactggttctctt

SEQ ID NO: 4468 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 5: mod_base = OTHER; note = 2'-deoxy-2'-fluoro ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..13: mod_base = OTHER; note = 2'-deoxy-2'-fluoro ribonucleotide
  modified_base 15: mod_base = OTHER; note = 2'-deoxy-2'-fluoro ribonucleotide
  modified_base 17: mod_base = OTHER; note = 2'-deoxy-2'-fluoro ribonucleotide
  modified_base 19: mod_base = OTHER; note = 2'-deoxy-2'-fluoro ribonucleotide
  modified_base 21: mod_base = OTHER; note = 2'-deoxy-2'-fluoro ribonucleotide
gcagctgctactggttctctt

SEQ ID NO: 4469 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4470 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8..9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4471 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..8: mod_base = OTHER; note = 2'-O-methyl ribonucleotide
  modified_base 9: mod_base = OTHER; note = 2'-deoxy-2'-fluoro ribonucleotide
  modified_base 10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4472 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atgggcctccacgaccaaatt

SEQ ID NO: 4473 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcacgagcgcagctgctactt

SEQ ID NO: 4474 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ttcaccgacgacggccgcttt

SEQ ID NO: 4475 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gaagtgggtggacgggacgtt

SEQ ID NO: 4476 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tcacgtcctgggaggagcatt

SEQ ID NO: 4477 - RNA, 21 nt, synthetic construct
  source 1..21: mol_type = other RNA
  misc_feature 21: note = invAb
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 21: mod_base = OTHER; note = phosphorothioate internucleotide linkage
gtgggaagaaagatgaagttt

SEQ ID NO: 4478 - RNA, 21 nt, synthetic construct
  source 1..21: mol_type = other RNA
  misc_feature 1: note = invAb
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4479 - RNA, 21 nt, synthetic construct
  source 1..21: mol_type = other RNA
  misc_feature 1: note = invAb
  misc_feature 21: note = invAb
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 21: mod_base = OTHER; note = phosphorothioate internucleotide linkage
gtgggaagaaagatgaagttt

SEQ ID NO: 4480 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4481 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 3..4: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4482 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 18..19: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4483 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 20..21: mod_base = OTHER; note = phosphorothioate internucleotide linkage
gtgggaagaaagatgaagttt

SEQ ID NO: 4484 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
gtgggaagaaagatgaagttt

SEQ ID NO: 4485 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ccgctggaacgacgacgtctt

SEQ ID NO: 4486 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gatgccacgtttggcgtgctt

SEQ ID NO: 4487 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gagcacccagggaggcaattt

SEQ ID NO: 4488 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ggcttgagcacccagggagtt

SEQ ID NO: 4489 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gaagaaagatgaagtcgcttt

SEQ ID NO: 4490 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gagatgccacgtttggcgttt

SEQ ID NO: 4491 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cgggacggactacgagacgtt

SEQ ID NO: 4492 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ctacgagacgggcttcaagtt

SEQ ID NO: 4493 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cccgggcactggagatgcctt

SEQ ID NO: 4494 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tgaaacccgtggcgctttctt

SEQ ID NO: 4495 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ggtggtcacgtcctgggagtt

SEQ ID NO: 4496 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cagaaatttgtccagcacctt

SEQ ID NO: 4497 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
atgccacgtttggcgtgcttt

SEQ ID NO: 4498 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agctgcggggcctgagagatt

SEQ ID NO: 4499 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gccctatcatgaccaaggatt

SEQ ID NO: 4500 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agcaacttcacagcgagcatt

SEQ ID NO: 4501 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
agcagaaatttgtccagcatt

SEQ ID NO: 4502 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aaaacgggccctggaagtgtt

SEQ ID NO: 4503 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gcctgagctgtcagatggctt

SEQ ID NO: 4504 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tggagatgccacgtttggctt

SEQ ID NO: 4505 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
actacgagacgggcttcaatt

SEQ ID NO: 4506 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
aagtgggtggacgggacggtt

SEQ ID NO: 4507 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
tgcacagcactgaagaacctt

SEQ ID NO: 4508 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
acggactacgagacgggcttt

SEQ ID NO: 4509 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
ggacgactggtacggccactt

SEQ ID NO: 4510 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gagctgcggggcctgagagtt

SEQ ID NO: 4511 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..12: mod_base = OTHER; note = 2'-deoxy-2'-fluoro ribonucleotide
  modified_base 13..14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
cacgtttggcgtgcttggatt

SEQ ID NO: 4512 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6..7: mod_base = OTHER; note = 2'-O-methyl ribonucleotide
  modified_base 8..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 19..20: mod_base = OTHER; note = phosphorothioate internucleotide linkage
  modified_base 20..21: mod_base = OTHER; note = phosphorothioate internucleotide linkage
gtgggaagaaagatgaagttt

SEQ ID NO: 4513 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4514 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4515 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4516 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4517 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4518 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4519 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4520 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4521 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4522 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4523 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4524 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4525 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4526 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4527 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4528 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4529 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4530 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4531 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gagaaccagtagcagctgctt

SEQ ID NO: 4532 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
cttcatctttcttcccacatt

SEQ ID NO: 4533 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gtgaagtgggcacagtccttt

SEQ ID NO: 4534 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
agttcttgaagcccgtctctt

SEQ ID NO: 4535 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
accagtagcagctgcgctctt

SEQ ID NO: 4536 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atccgatcacacagacaactt

SEQ ID NO: 4537 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctcaggccccgcagctcctt

SEQ ID NO: 4538 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acgtcgtcgttccagcggctt

SEQ ID NO: 4539 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctgtctcgcagacccagctt

SEQ ID NO: 4540 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tgaaaattcccgagaaagctt

SEQ ID NO: 4541 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aaccacaagcagcaggaggtt

SEQ ID NO: 4542 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tactccttggtcatgatagtt

SEQ ID NO: 4543 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttctgctcctcccaggacgtt

SEQ ID NO: 4544 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aagcagaagaggcccccagtt

SEQ ID NO: 4545 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
actccttggtcatgataggtt

SEQ ID NO: 4546 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ttcggaacatcaccctatctt

SEQ ID NO: 4547 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
atgataacctgcaaactgctt

SEQ ID NO: 4548 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
cgacttcatctttcttcccactt

SEQ ID NO: 4549 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
gagagaaccagtagcagctgctt

SEQ ID NO: 4550 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
gacttcatctttcttcccacatt

SEQ ID NO: 4551 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
acttcatctttcttcccacattt

SEQ ID NO: 4552 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
gagaaccagtagcagctgcgctt

SEQ ID NO: 4553 - RNA, 23 nt, synthetic construct
  source 1..23: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 22: mod_base = OTHER; note = 2'-deoxy-2'-fluoro ribonucleotide
  modified_base 23: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21..22: mod_base = OTHER; note = phosphorothioate internucleotide linkage
  modified_base 22..23: mod_base = OTHER; note = phosphorothioate internucleotide linkage
cttcatctttcttcccacatttt

SEQ ID NO: 4554 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctcgtagtccgtcccgtctt

SEQ ID NO: 4555 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aattaaaggagaggtggcttt

SEQ ID NO: 4556 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gctcaggctccgcaggtcatt

SEQ ID NO: 4557 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaggcccagggagagcaggtt

SEQ ID NO: 4558 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gcccagggagagcaggaggtt

SEQ ID NO: 4559 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgagagaaccagtagcagctt

SEQ ID NO: 4560 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ctgaagcttggagaatgggtt

SEQ ID NO: 4561 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ccggagcgagagaaccagttt

SEQ ID NO: 4562 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctcgtagtccgtcccgtctt

SEQ ID NO: 4563 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aattaaaggagaggtggcttt

SEQ ID NO: 4564 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtagcagctgcgctcgtgctt

SEQ ID NO: 4565 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaaccagtagcagctgcgctt

SEQ ID NO: 4566 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtctcgtagtccgtcccgttt

SEQ ID NO: 4567 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaactgcttcacgtggagctt

SEQ ID NO: 4568 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gctcaggctccgcaggtcatt

SEQ ID NO: 4569 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ctctctcaggccccgcagctt

SEQ ID NO: 4570 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agcggccgtcgtcggtgaatt

(The sequence listing continues in the following parts.)

What is claimed:

1. An RNAi construct comprising a sense strand and an antisense strand, wherein the sense strand and antisense strand hybridize to form a duplex region of about 15 to about 30 base pairs in length, and wherein the antisense strand comprises a region having a sequence that is fully complementary to the sequence of at least 15 consecutive nucleotides of nucleotides 886 to 910 of the ASGR1 mRNA sequence of SEQ ID NO: 1.

2. The RNAi construct of claim 1, wherein the sense strand and the antisense strand are each about 15 to about 30 nucleotides in length.

3. The RNAi construct of claim 2, wherein the sense strand and the antisense strand are each about 19 to about 27 nucleotides in length.

4. The RNAi construct of claim 2, wherein the sense strand and the antisense strand are each about 21 to about 25 nucleotides in length.

5. The RNAi construct of claim 1, wherein the RNAi construct comprises at least one blunt end.

6. The RNAi construct of claim 1, wherein the RNAi construct comprises at least one nucleotide overhang of 1 to 4 unpaired nucleotides.

7. The RNAi construct of claim 6, wherein the RNAi construct comprises a nucleotide overhang at the 3' end of the sense strand, the 3' end of the antisense strand, or the 3' end of both the sense strand and the antisense strand.

8. The RNAi construct of claim 1, wherein the RNAi construct comprises one or more modified nucleotides.

9. The RNAi construct of claim 8, wherein the one or more modified nucleotides are 2'-modified nucleotides.

10. The RNAi construct of claim 8, wherein the one or more modified nucleotides are 2'-fluoro modified nucleotides, 2'-O-methyl modified nucleotides, 2'-O-methoxyethyl modified nucleotides, 2'-O-allyl modified nucleotides, bicyclic nucleic acids (BNAs), or combinations thereof.

11. The RNAi construct of claim 8, wherein all of the nucleotides in the sense and antisense strands are modified nucleotides.

12. The RNAi construct of claim 11, wherein the modified nucleotides are 2'-O-methyl modified nucleotides, 2'-fluoro modified nucleotides, or combinations thereof.

13. The RNAi construct of claim 1, wherein the RNAi construct comprises at least one phosphorothioate internucleotide linkage.

14. The RNAi construct of claim 13, wherein the RNAi construct comprises two consecutive phosphorothioate internucleotide linkages at the 3' end of the antisense strand.

15. The RNAi construct of claim 13, wherein the RNAi construct comprises two consecutive phosphorothioate internucleotide linkages at both the 3' and 5' ends of the antisense strand and two consecutive phosphorothioate internucleotide linkages at the 5' end of the sense strand.

16. The RNAi construct of claim 1, wherein the antisense strand comprises a sequence selected from any one of SEQ ID NOs: 2867-2871 and 2873.

17. The RNAi construct of claim 16, wherein the sense strand comprises a sequence selected from any one of SEQ ID NOs: 1364-1368 and 1370.

18. The RNAi construct of claim 16, wherein:

(a) the sense strand comprises the sequence of SEQ ID NO: 1364 and the antisense strand comprises the sequence of SEQ ID NO: 2867;

(b) the sense strand comprises the sequence of SEQ ID NO: 1365 and the antisense strand comprises the sequence of SEQ ID NO: 2868;

(c) the sense strand comprises the sequence of SEQ ID NO: 1366 and the antisense strand comprises the sequence of SEQ ID NO: 2869;

(d) the sense strand comprises the sequence of SEQ ID NO: 1367 and the antisense strand comprises the sequence of SEQ ID NO: 2870;

(e) the sense strand comprises the sequence of SEQ ID NO: 1368 and the antisense strand comprises the sequence of SEQ ID NO: 2871; or (f) the sense strand comprises the sequence of SEQ ID NO: 1370 and the antisense strand comprises the sequence of SEQ ID NO: 2873.

19. The RNAi construct of claim 1, wherein the RNAi construct further comprises a ligand.

20. The RNAi construct of claim 19, wherein the ligand comprises a cholesterol moiety, a vitamin, a steroid, a bile acid, a folate moiety, a fatty acid, a carbohydrate, a glycoside, or antibody or antigen-binding fragment thereof.

21. The RNAi construct of claim 19, wherein the ligand targets delivery of the RNAi construct to hepatocytes.

22. The RNAi construct of claim 21, wherein the ligand comprises a monoclonal antibody or antigen-binding fragment thereof that specifically binds to human ASGR1.

23. The RNAi construct of claim 22, wherein the monoclonal antibody or antigen-binding fragment thereof comprises a substitution of at least one amino acid with a cysteine amino acid, and wherein the sense strand is covalently attached to the monoclonal antibody or antigen-binding fragment thereof through the side chain of the cysteine amino acid.

24. The RNAi construct of claim 19, wherein the ligand comprises galactose, galactosamine, or N-acetyl-galactosamine.

25. The RNAi construct of claim 24, wherein the ligand comprises a multivalent galactose moiety or multivalent N-acetyl-galactosamine moiety.

26. The RNAi construct of claim 25, wherein the multivalent galactose moiety or multivalent N-acetyl-galactosamine moiety is trivalent or tetravalent.

27. The RNAi construct of claim 19, wherein the ligand is covalently attached to the sense strand optionally through a linker.

28. The RNAi construct of claim 27, wherein the ligand is covalently attached to the 3' end or 5' end of the sense strand.

29. A pharmaceutical composition comprising the RNAi construct of claim 1 and a pharmaceutically acceptable carrier, excipient, or diluent.

30. A method for reducing the expression of ASGR1 in a patient in need thereof comprising administering to the patient the RNAi construct of claim 1.

31. A method for reducing non-HDL cholesterol in a patient in need thereof comprising administering to the patient the RNAi construct of claim 1.

32. A method for treating cardiovascular disease in a patient in need thereof comprising administering to the patient the RNAi construct of claim 1.

33. A method for reducing the risk of myocardial infarction in a patient in need thereof comprising administering to the patient the RNAi construct of claim 1.

34. The RNAi construct of claim 18, wherein:

(a) the sense strand comprises the sequence of modified nucleotides according to SEQ ID NO: 4331 and the antisense strand comprises the sequence of modified nucleotides according to SEQ ID NO: 4520;

(b) the sense strand comprises the sequence of modified nucleotides according to SEQ ID NO: 4381 and the antisense strand comprises the sequence of modified nucleotides according to SEQ ID NO: 4565;

(c) the sense strand comprises the sequence of modified nucleotides according to SEQ ID NO: 4392 and the antisense strand comprises the sequence of modified nucleotides according to SEQ ID NO: 4576;

(d) the sense strand comprises the sequence of modified nucleotides according to SEQ ID NO: 4413 and the antisense strand comprises the sequence of modified nucleotides according to SEQ ID NO: 4520;

(e) the sense strand comprises the sequence of modified nucleotides according to SEQ ID NO: 4426 and the antisense strand comprises the sequence of modified nucleotides according to SEQ ID NO: 4523;

(f) the sense strand comprises the sequence of modified nucleotides according to SEQ ID NO: 4441 and the antisense strand comprises the sequence of modified nucleotides according to SEQ ID NO: 4523;

(g) the sense strand comprises the sequence of modified nucleotides according to SEQ ID NO: 4426 and the antisense strand comprises the sequence of modified nucleotides according to SEQ ID NO: 4616;

(h) the sense strand comprises the sequence of modified nucleotides according to SEQ ID NO: 4463 and the antisense strand comprises the sequence of modified nucleotides according to SEQ ID NO: 4638;

(i) the sense strand comprises the sequence of modified nucleotides according to SEQ ID NO: 4464 and the antisense strand comprises the sequence of modified nucleotides according to SEQ ID NO: 4639;

(j) the sense strand comprises the sequence of modified nucleotides according to SEQ ID NO: 4466 and the antisense strand comprises the sequence of modified nucleotides according to SEQ ID NO: 4641;

(k) the sense strand comprises the sequence of modified nucleotides according to SEQ ID NO: 4467 and the antisense strand comprises the sequence of modified nucleotides according to SEQ ID NO: 4642; or (l) the sense strand comprises the sequence of modified nucleotides according to SEQ ID NO: 4468 and the antisense strand comprises the sequence of modified nucleotides according to SEQ ID NO: 4643.

* * * * *